US008119140B2

(12) United States Patent
Korber et al.

(10) Patent No.: US 8,119,140 B2
(45) Date of Patent: Feb. 21, 2012

(54) IMMUNOGENIC COMPOSITIONS COMPRISING HUMAN IMMUNODEFICIENCY VIRUS (HIV) MOSAIC NEF PROTEINS

(75) Inventors: Bette T. Korber, Los Alamos, NM (US); Simon Perkins, Los Alamos, NM (US); Tanmoy Bhattacharya, Los Alamos, NM (US); William M. Fischer, Los Alamos, NM (US); James Theiler, Los Alamos, NM (US); Norman Letvin, Boston, MA (US); Barton F. Haynes, Durham, NC (US); Beatrice H. Hahn, Birmingham, AL (US); Karina Yusim, Los Alamos, NM (US); Carla Kuiken, Los Alamos, NM (US)

(73) Assignees: Los Alamos Security, LLC, Los Alamos, NM (US); Beth Israel Deaconess Medical Center, Boston, MA (US); Duke University, Durham, NC (US); The University of Alabama at Birmingham Research Foundation, Birmingham, AL (US)

( * ) Notice: Subject to any disclaimer, the term of this patent is extended or adjusted under 35 U.S.C. 154(b) by 0 days.

(21) Appl. No.: 11/990,222

(22) PCT Filed: Aug. 23, 2006

(86) PCT No.: PCT/US2006/032907

§ 371 (c)(1),
(2), (4) Date: Apr. 20, 2009

(87) PCT Pub. No.: WO2007/024941

PCT Pub. Date: Mar. 1, 2007

(65) Prior Publication Data

US 2009/0324631 A1 Dec. 31, 2009

Related U.S. Application Data

(60) Provisional application No. 60/710,154, filed on Aug. 23, 2005, provisional application No. 60/739,413, filed on Nov. 25, 2005.

(51) Int. Cl.
*A61K 39/21* (2006.01)

(52) U.S. Cl. ................................ 424/188.1; 424/208.1

(58) Field of Classification Search ........................ None
See application file for complete search history.

(56) References Cited

U.S. PATENT DOCUMENTS

| | | | |
|---|---|---|---|
| 7,951,377 | B2 | 5/2011 | Korber et al. |
| 2002/0198162 | A1 | 12/2002 | Punnonen et al. |
| 2003/0044421 | A1 | 3/2003 | Emini et al. |
| 2003/0104011 | A1 | 6/2003 | Rios |
| 2003/0147888 | A1 | 8/2003 | Haynes et al. |
| 2003/0180314 | A1 | 9/2003 | DeGroot |
| 2003/0194411 | A1 | 10/2003 | Rubinstein et al. |
| 2006/0216305 | A1 | 9/2006 | Lal et al. |
| 2006/0275897 | A1 | 12/2006 | Nabel et al. |
| 2011/0150915 | A1 | 6/2011 | Korber et al. |

FOREIGN PATENT DOCUMENTS

| | | |
|---|---|---|
| WO | WO 2007/024941 | 3/2007 |
| WO | WO 2007/047916 | 4/2007 |

OTHER PUBLICATIONS

International Search Report dated Jul. 3, 2008—International Appln. No. PCT/US06/32907.

Shinoda et al, "Polygene DNA vaccine induces a high level of protective effect against HIV-vaccinia virus challenge in mice", Vaccine 22:3676-3690 (2004).

International Search Report dated Aug. 27, 2008—International Appln. No. PCT/US06/32907.

International Search Report dated Apr. 6, 2010—International Appln. No. PCT/US2009/004664.

Office Action dated Jun. 23, 2010 issued in connection with U.S. Appl. No. 12/192,015.

U.S. Appl. No. 13/094,734, filed Apr. 26, 2011, Korber et al., continuation of U.S. Appl. No. 12/192,015, now USP 7,951,377.

*Primary Examiner* — Jeffrey S. Parkin

(74) *Attorney, Agent, or Firm* — Nixon & Vanderhye P.C.

(57) ABSTRACT

The present invention relates to mosaic clade M HIV-1 Nef polypeptides and to compositions comprising same. The polypeptides of the invention are suitable for use in inducing an immune response to HIV-1 in a human.

7 Claims, 52 Drawing Sheets

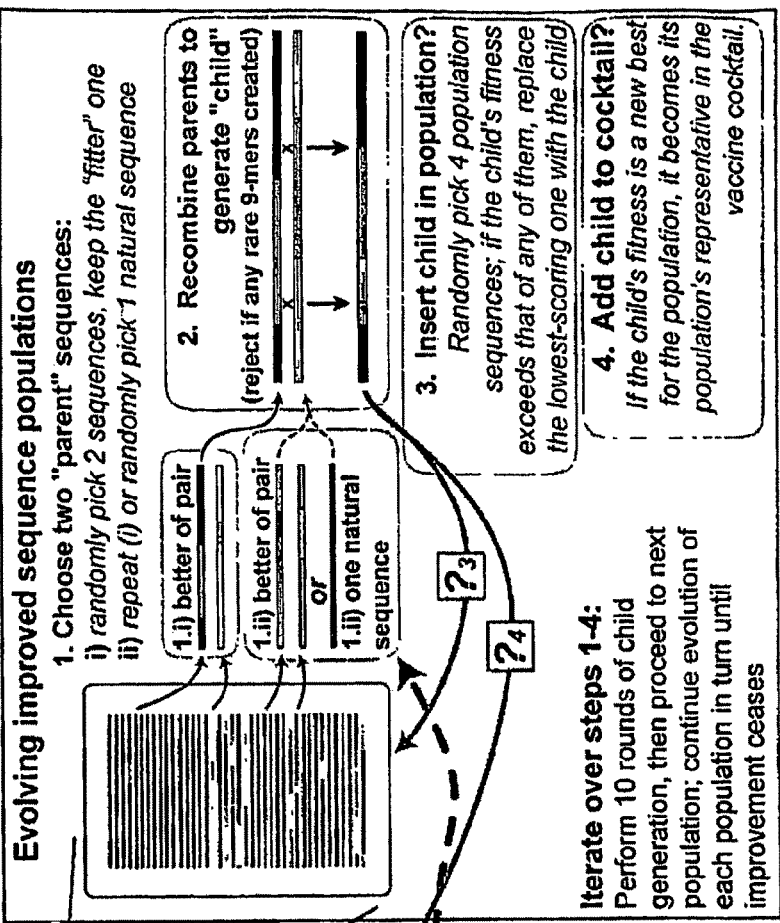
Fig. 2C
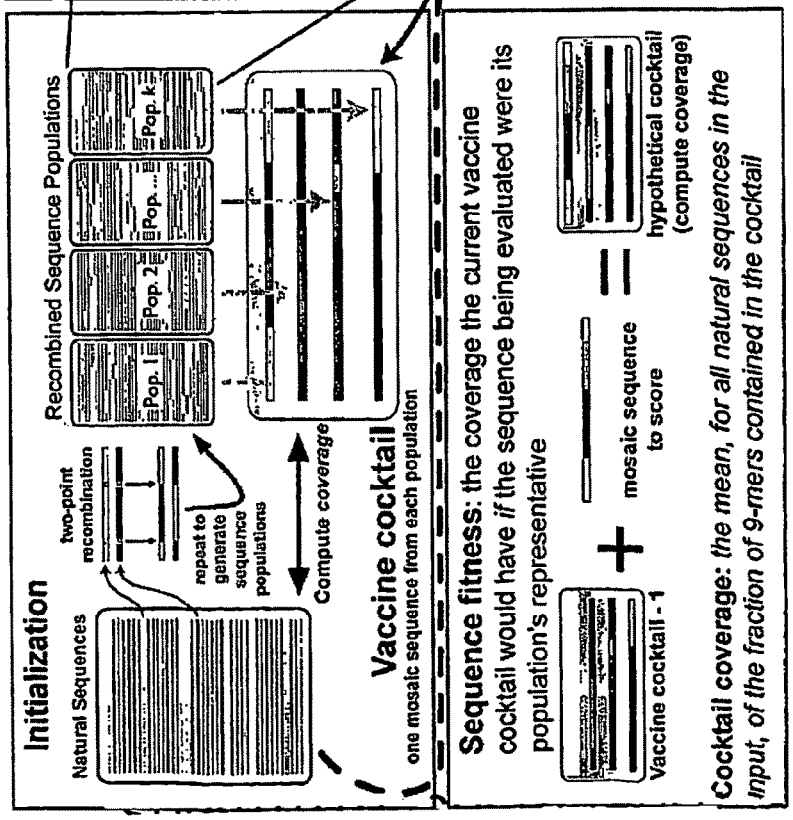
Fig. 2A
Fig. 2B

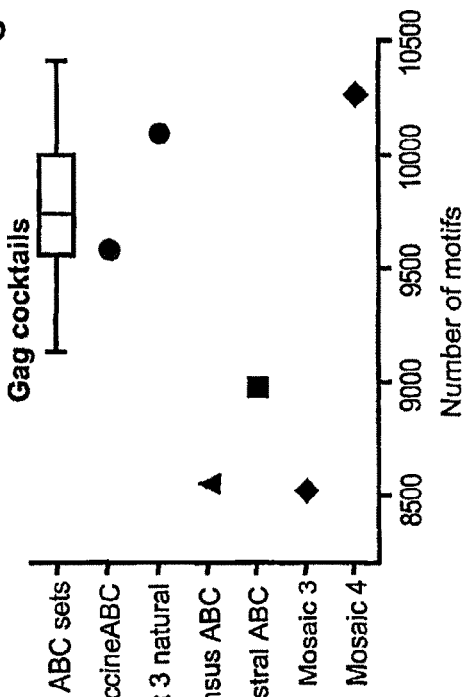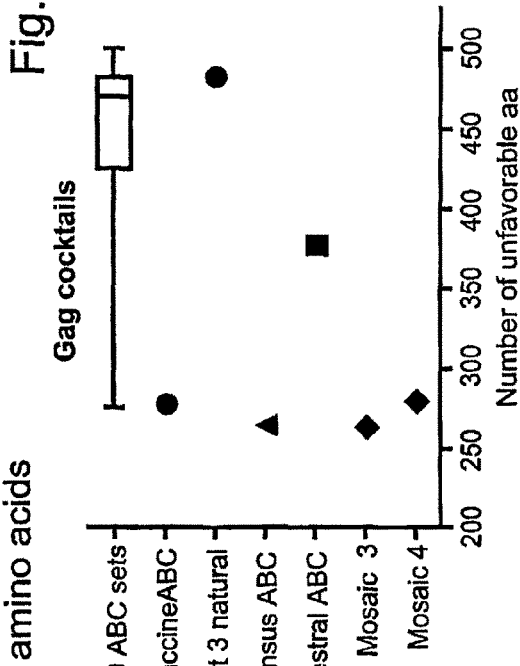
Fig. 8A
Fig. 8B
Fig. 8C
Fig. 8D

Fig. 9

>nef_coreB.syn1.1
EVGFPVRPQVPLRPMTYKGALDLSHFLKEKGGLEGLIYSQKRQDILDLWVYHTQGYFPDW
QNYTPGPGIRYPLTFGWCFKLVPVE >nef_coreB.syn3.1
EVGFPVKPQVPLRPMTYKAAVDLSHFLKEKGGLEGLVYSQKRQDILDLWIYHTQGYFPDW
QNYTPGPGTRFPLTFGWCFKLVPVD
>nef_coreB.syn3.2
EVGFPVTPQVPLRPMTYKGALDLSHFLREKGGLEGLIYSQKRQEILDLWVYHTQGYFPDW
HNYTPGPGVRYPLTFGWCFKLVPVE
>nef_coreB.syn3.3
EVGFPVRPQVPLRPMTYKAALDLSHFLKEKGGLEGLIHSQRRQDILDLWVYHTQGFFPDW
QNYTPGPGIRYPLTFGWCYKLVPVE >nef_coreB.syn4.1
EVGFPVTPQVPLRPMTYKAAVDLSHFLREKGGLEGLIHSQKRQDILDLWIYHTQGYFPDW
QNYTPGPGIRYPLTFGWCYKLVPVE
>nef_coreB.syn4.2
DVGFPVRPQIPLRPMTYKAALDLSHFLREKGGLEGLVYSQKRQDILDLWVYHTQGFFPDW
QNYTPGPGTRFPLTFGWCFKLVPVD
>nef_coreB.syn4.3
EVGFPVRPQVPLRPMTYKGAVDLSHFLKEKGGLEGLIYSQKRQEILDLWVYHTQGYFPDW
GNYTPGPGTRYPLTFGWCLKLVPVE
>nef_coreB.syn4.4
EVGFPVKPQVPLRPMTYKGALDLSHFLKEKGGLDGLIYSQRRQDILDLWVYNTQGYFPDW
HNYTPGPGVRYPLTFGWCFKLVPVE >nef_coreB.syn6.1
EVGFPIRPQVPLRPMTFKGALDLSHFLKEKGGLDGLIYSQKRQEILDLWVYHTQGYFPDW
HNYTPGPGIRYPLCFGWCFKLVPVE
>nef_coreB.syn6.2
EVGFPVTPQVPLRPMTYKGAVDLSHFLKEQGGLEGLIYSQRRQDILDLWIYNTQGYFPDW
QCYTPGPGVRFPLTFGWCFKLEPVD
>nef_coreB.syn6.3
EVGFPVKPQVPLRPMTYKAAVDLSHFLKEKGGLEGLIYSQKRQDILDLWIYHTQGYFPDW
QNYTPGPGIRYPLTFGWCLKLVPVE
>nef_coreB.syn6.4
DVGFPVRPQVPLRPMTYKAALDLSHFLKEEGGLEGLIYSQQRQDILDLWVYHTQGFFPDW
QNYTPGPGTRYPLTFGWCYKLVPVE
>nef_coreB.syn6.5
EVGFPVRPQIPLRPMTYKGALDLSHFLREKGGLEGLVYSQKRQDILDLWVHHTQGYFPDW
GNYTPGPGTRFPLTFGWCFKLVPVD
>nef_coreB.syn6.6
EVGFPVRPQVPLRPMTYKGAFDLSHFLKDKGGLEGLIHSQKRQDILDLWVYNTQGYFPDW
QNYTPGPGVRYPLTFGWCFKLVPLE >nef_coreC.syn1.1
EVGFPVRPQVPLRPMTYKAAFDLSFFLKEKGGLEGLIYSKKRQEILDLWVYHTQGFFPDW
QNYTPGPGVRYPLTFGWCFKLVPVD

Fig. 9 cont'd-1

```
>nef_coreC.syn3.1
EVGFPVTPQVPLRPMTFKGAFDLGFFLKEKGGLDGLIYSKKRQDILDLWVYHTQGYFPDW
QNYTPGPGVRYPLTFGWCYKLVPVD
>nef_coreC.syn3.2
EVGFPVKPQVPLRPMTYKAAFDLSFFLKDKGGLEGLIWSKKRQEILDLWVYHTQGFFPDW
QNYTPGPGIRYPLTFGWPFKLVPVD
>nef_coreC.syn3.3
EVGFPVRPQVPLRPMTYKGAFDLSFFLKEKGGLEGLIYSKKRQEILDLWVYNTQGFFPDW
HNYTPGPGVRFPLTFGWCFKLVPVD >nef_coreC.syn4.1
EVGFPVRPQVPLRPMTYKGAFDLSFFLKEKGGLEGLIWSKKRQEILDLWVYNTQGYFPDW
QCYTPGPGVRFPLTFGWCFKLVPVD
>nef_coreC.syn4.2
DVGFPVRPQVPVRPMTYKAAFDLSFFLKDKGGLEGLIHSKRRQDILDLWVYNTQGFFPDW
HNYTPGPGIRYPLTFGWCFKLVPVD
>nef_coreC.syn4.3
EVGFPVKPQVPLRPMTYKAAVDLSFFLKEKGGLEGLIYSKKRQEILDLWVYHTQGFFPDW
QNYTPGPGTRYPLTFGWPFKLVPVD
>nef_coreC.syn4.4
EVGFPVTPQVPLRPMTFKGAFDLGFFLKEKGGLDGLIYSKKRQDILDLWVYHTQGYFPDW
QNYTPGPGVRYPLTFGWCYKLVPVD >nef_coreC.syn6.1
DVGFPVRPQVPLRPMTYKGAFDLSFFLKEKGGLDGLIYSKKRQEILDLWVYNTQGYFPDW
QCYTPGPGVRYPLTFGWCYKLVPVD
>nef_coreC.syn6.2
EVGFPVKPQVPVRPMTYKAAFDLSFFLKDKGGLEGLIWSKKRQEILDLWVYHTQGFFPDW
QNYTPGPGIRYPLTFGWCFKLVPVD
>nef_coreC.syn6.3
EVGFPVKPQVPLRPMTFKGAFDLGFFLKEKGGLEGLIYSKQRQDILDLWVYHTQGFFPDW
HNYTPGPGVRLPLTFGWCFKLVPVD
>nef_coreC.syn6.4
GVGFPVRPQVPVRPMTYKAAFDLGFFLKDKGGLEGLIYSKKRQDILDLWVYNTQGFFPDW
QNYTPGPGVRFPLTFGWCFKLVPVD
>nef_coreC.syn6.5
EVGFPVTPQVPLRPMTYKAAVDLSWFLKEKGGLDGLIYSRKRQEILDLWVHHTQGFFPDW
QNYTPGPGTRFPLTFGWCFKLVPVD
>nef_coreC.syn6.6
EVGFPVRPQVPVRPMTYKGAVDLSFFLKEKGGLEGLIHSKRRQDILDLWVYHTQGYFPDW
QNYTPGPGTRYPLTFGWPFKLVPVD >nef_coreM.syn1.1
EVGFPVRPQVPLRPMTYKGALDLSHFLKEKGGLEGLIYSKKRQEILDLWVYHTQGYFPDW
QNYTPGPGVRYPLTFGWCFKLVPVD
```

Fig. 9 cont'd-2

```
>nef_coreM.syn3.1
DVGFPVRPQVPLRPMTYKAAVDLSHFLKEKGGLEGLVYSQKRQDILDLWVYHTQGFFPDW
QNYTPGPGVRYPLTFGWCYKLVPVD
>nef_coreM.syn3.2
EVGFPVRPQVPVRPMTYKGAFDLSFFLKEKGGLEGLIYSKKRQEILDLWVYHTQGYFPDW
HNYTPGPGTRFPLTFGWCFKLVPVD
>nef_coreM.syn3.3
EVGFPVKPQVPLRPMTYKGALDLSHFLKEKGGLDGLIYSKKRQDILDLWVYNTQGYFPDW
QNYTPGPGIRYPLTFGWCFKLVPVE >nef_coreM.syn4.1
EVGFPVTPQVPLRPMTFKGAFDLGFFLKEKGGLEGLIYSKKRQEILDLWVYHTQGFFPDW
QNYTPGPGTRYPLCFGWCFKLVPVE
>nef_coreM.syn4.2
EVGFPVKPQVPLRPMTYKAAVDLSHFLKEKGGLEGLVYSQKRQDILDLWVYHTQGYFPDW
QNYTPGPGIRYPLTFGWCYKLVPVD
>nef_coreM.syn4.3

DVGFPVRPQVPLRPMTYKGALDLSHFLKEEGGLEGLIYSQKRQEILDLWVYNTQGYFPDW
QNYTPGPGVRYPLTFGWCFKLVPVD
>nef_coreM.syn4.4
EVGFPVRPQVPVRPMTYKGAFDLSFFLKEKGGLDGLIYSKKRQDILDLWVYNTQGFFPDW
HNYTPGPGTRFPLTFGWCFELVPVD >nef_coreM.syn6.1
EVGFPVRPQVPTRPMTYKGAVDLSHFLKEKGGLEGLVYSQKRQDILDLWVHHTQGFFPDW
QNYTPGPGTRYPLTFGWPFKLVPVD
>nef_coreM.syn6.2
DVGFPVRPQVPVRPMTYKAAFDLSFFLREKGGLDGLIYSKKRQDILDLWVYNTQGYFPDW
QNYTPGPGVRFPLTFGWCFELVPVD
>nef_coreM.syn6.3
NVGFPVRPQVPLRPMTFKGAFDLGFFLKEKGGLEGLIYSKKRQEILDLWVYHTQGYFPDW
HNYTPGPGTRFPLTFGWCFKLVPVE
>nef_coreM.syn6.4
EVGFPVTPQVPLRPMTYKGAFDLSFFLKEKGGLDGLIYSRKRQEILDLWVYNTQGFFPDW
QNYTPGPGIRYPLTFGWCFKLVPMD
>nef_coreM.syn6.5
EVGFPVKPQVPLRPMTYKAAVDLSHFLREKGGLEGLIHSQRRQDILDLWIYHTQGYFPDW
QCYTPGPGVRYPLTFGWCYKLVPVD
>nef_coreM.syn6.6
GVGFPVRPQIPLRPMTYKGALDLSHFLKEEGGLEGLIYSQKRQDILDLWVYHTQGFFPDW
HNYTPGPGIRYPLCFGWCFKLVPVD
```

Fig. 9 cont'd-3

>gagB.syn1.1
MGARASVLSGGELDRWEKIRLRPGGKKKYKLKHIVWASRELERFAVNPGLLETSEGCRQI
LGQLQPSLQTGSEELRSLYNTVATLYCVHQRIEVKDTKEALDKIEEEQNKSKKKAQQAAA
DTGNSSQVSQNYPIVQNLQGQMVHQAISPRTLNAWVKVVEEKAFSPEVIPMFSALSEGAT
PQDLNTMLNTVGGHQAAMQMLKETINEEAAEWDRLHPVHAGPIAPGQMREPRGSDIAGTT
STLQEQIGWMTNNPPIPVGEIYKRWIILGLNKIVRMYSPTSILDIRQGPKEPFRDYVDRF
YKTLRAEQASQEVKNWMTETLLVQNANPDCKTILKALGPAATLEEMMTACQGVGGPGHKA
RVLAEAMSQVTNSATIMMQRGNFRNQRKTVKCFNCGKEGHIAKNCRAPRKKGCWKCGKEG
HQMKDC-TERQANFLGKIWPSHKG-RPGNFLQSRP-----------------EPTAP
PEESFRFGEETTTPSQKQEPIDKELYPLASLRSLFGNDPSSQ >gagB.syn3.1
MGARASILSGGELDRWEKIRLRPGGKKQYRLKHIVWASRELERFAINPGLLETSDGCRQI
LGQLQPALQTGSEELKSLFNTVATLYCVHQRIDVKDTKEALDKIEEEQNKSKKKAQQAAA
DTGNSSQVSQNYPIVQNIQGQMVHQAISPRTLNAWVKVIEEKAFSPEVIPMFSALSEGAT
PQDLNTMLNTVGGHQAAMQMLKETINEEAADWDRLHPVHAGPIAPGQMREPRGSDIAGTT
STLQEQIGWMTNNPPIPVGEIYKRWIIMGLNKIVRMYSPSSILDIKQGPKEPFRDYVDRF
YKVLRAEQASQEVKNWMTETLLVQNSNPDCKTILKALGPGATLEEMMTACQGVGGPGHKA
RVLAEAMSQMTNSATIMMQKGNFRNQRKPVKCFNCGKEGHIAKNCRAPRKKGCWKCGREG
HQMKDC-TERQANFLGKIWPSYKG-RPGNFLQNRP-----------------EPTAP
PAESFRFGEETTTPSQKQETIDKELYPLASLRSLFGSDPSSQ >gagB.syn3.2
MGARASVLSGGQLDRWEKIRLRPGGKKKYRLKHLVWASRELERFAVNPGLLETAEGCRQI
LEQLQPSLQTGSEELRSLFNTVAVLYCVHQRIEVKDTKEALDKVEEEQNKSKKKAQQTAA
DTGNNSQVSQNYPIVQNMQGQMVHQALSPRTLNAWVKVIEEKAFSPEVIPMFTALSEGAT
PQDLNTMLNTVGGHQAAMQMLKDTINEEAAEWDRLHPVQAGPVAPGQIREPRGSDIAGST
STLQEQIGWMTSNPPIPVGEIYKRWIILGLNKIVRMYSPVSILDIRQGPKEPFRDYVDRF
YKTLRAEQATQEVKNWMTETLLVQNANPDCKTILKALGPGATLEEMMTACQGVGGPSHKA
RVLAEAMSQVTNSATIMMQRGNFRNQRKIVKCFNCGKEGHIARNCRAPRKRGCWKCGKEG
HQMKDC-NERQANFLGKIWPSHKG-RPGNFLQSRP-----------------EPSAP
PEESFRFGEEKTTPSQKQEPIDKDLYPLASLKSLFGNDPSLQ >gagB.syn3.3
MGARASVLSGGELDKWEKIRLRPGGKKKYKLKHIVWASRELERFAVNPGLLETSEGCRQI
LGQLQPSLQTGSEELRSLYNTVATLYCVHQKIEVKDTKEALEKIEEEQNKCKKKAQQAAA
GTGNSSQVSQNYPIVQNLQGQMVHQPISPRTLNAWVKVVEEKAFSPEVIPMFSALAEGAT
PQDLNTMLNTVGGHQAAMQMLKETINEEAAEWDRLHPVHAGPVAPGQMRDPRGSDIAGTT
SNLQEQIGWMTHNPPIPVGDIYKRWIILGLNKIVRMYSPTSILDIRQGPKESFRDYVDRF
YKTLRAEQASQDVKNWMTETLLVQNANPDCRTILKALGPAATLEEMMTACQGVGGPSHKA
RILAEAMSQVTNPATIMMQRGNFRNQRKTVKCFNCGKEGHLARNCRAPRKKGCWKCGKEG
HQMKEC-TERQANFLGKIWPSHKG-RPGNFLQSRP-----------------EPTAP
PEESFRFGEETATPPQKQEPIDKELYPLTSLRSLFGNDPSSQ >gagB.syn4.1
MGARASVLSGGQLDRWEKIRLRPGGKKKYRLKHLVWASRELERFAVNPGLLETAEGCRQI
LEQLQPSLQTGSEELRSLFNTVATLYCVHQRIDVKDTKEALDKIEEEQNKCKKKAQQAAA
DTGNSSQVSQNYPIVQNIQGQMVHQALSPRTLNAWVKVVEEKAFSPEVIPMFTALSEGAT
PQDLNTMLNTVGGHQAAMQMLKETINEEAAEWDRLHPVQAGPVAPGQMREPRGSDIAGST
STLQEQIGWMTNNPPIPVGDIYKRWIILGLNKIVRMYSPVSILDIRQGPKESFRDYVDRF
YKVLRAEQASQEVKNWMTETLLVQNANPDCRTILKALGPAATLEEMMTACQGVGGPGHKA

Fig. 9 cont'd-4

```
RVLAEAMSQMTNSATIMMQRGNFRNQRKTVKCFNCGKEGHIAKNCRAPRKKGCWKCGKEG
HQMKEC-TERQANFLGKIWPSYKG-RPGNFLQSRP------------------EPSAP
PAESFRFGEETTTPSQKQETIDKELYPLTSLRSLFGNDPSLQ
>gagB.syn4.2
MGARASVLSGGELDKWEKIRLRPGGKKKYKLKHIVWASRELERFAINPGLLETSEGCRQI
LGQLQPALQTGSEELRSLYNTVATLYCVHQKIEVKDTKEALEKVEEEQNKSKQKAQQAAA
DTGNNSQVSQNYPIVQNLQGQMVHQAISPRTLNAWVKVIEEKAFSPEVIPMFAALSEGAT
PQDLNTMLNTVGGHQAAMQMLKETINEEAADWDRLHPVHAGPIAPGQIREPRGSDIAGTT
SNLQEQIAWMTNNPPIPVGEIYKRWIIMGLNKIVRMYSPTSILDIKQGPKEPFRDYVDRF
YRTLRAEQASQDVKNWMTETLLVQNANPDCRTILKALGPGATLEEMMTACQGVGGPSHKA
RVLAEAMSQVTNPATIMMQRGNFRNQRKPVKCFNCGKEGHLAKNCRAPRKRGCWKCGKEG
HQMKDC-NERQANFLGKIWPSHKG-RPGNFLQNRP------------------EPSAP
PEESFRFGEETATPSQKQEPIDKELYPLASLRSLFGSDPSSQ
>gagB.syn4.3
MGARASILSGGELDRWEKIRLRPGGKKQYRLKHIVWASRELERFAVNPGLLETSEGCKQI
LEQLQPALQTGSEELKSLYNTVAVLYCVHQRIEIKDTKEALEKIEEEQNKSKKKAQQTAA
DTGNNSQVSQNYPIVQNLQGQMVHQPISPRTLNAWVKVIEEKAFSPEVIPMFSALAEGAT
PQDLNTMLNTVGGHQAAMQMLKETINEEAAEWDRLHPVHAGPVAPGQMRDPRGSDIAGTT
SNLQEQIGWMTSNPPIPVGEIYKRWIILGLNKIVRMYSPTSILDIRQGPKEPFRDYVDRF
YKTLRAEQATQEVKNWMTETLLVQNANPDCKTILKALGPGATLEEMMTACQGVGGPSHKA
RILAEAMSQVTNSATVMMQRGNFRNQRKTIKCFNCGKEGHLARNCRAPRKKGCWKCGREG
HQMKDC-TERQANFLGKIWPSYKG-RPGNFLQNRP------------------EPTAP
PAESFRFGEETTTPPQKQEPIDKELYPLASLKSLFGNDPSSQ
>gagB.syn4.4
MGARASVLSGGKLDKWEKIRLRPGGKKKYQLKHIVWASRELERFALNPGLLETSDGCRQI
LGQLQPSLQTGSEELKSLFNTVAVLYCVHQRIEVKDTKEALDKVEEEQNKSKKKAQQAAA
GTGNSSQVSQNYPIVQNMQGQMVHQALSPRTLNAWVKVIEEKAFSPEVIPMFSALSEGAT
PQDLNTMLNTVGGHQAAMQMLKDTINEEAAEWDRVHPVHAGPIAPGQMREPRGSDIAGTT
STLQEQIGWMTHNPPIPVGEIYKRWIILGLNKIVRMYSPSSILDIRQGPKEPFRDYVDRF
YKTLRAEQASQEVKNWMTETLLVQNSNPDCKTILKALGPAATLEEMMTACQGVGGPSHKA
RVLAEAMSQVTNSATIMMQKGNFRNQRKIVKCFNCGKEGHIARNCRAPRKKGCWRCGKEG
HQMKDC-TERQVNFLGKIWPSYKG-RPGNFLQSRP------------------EPTAP
PEESFRFGEEKTTPSQKQEPIDKDLYPLASLKSLFGNDPLSQ
>gagB.syn6.1
MGARASILSGGELDRWEKIRLRPGGSKKYRLKHIVWASRELERFAVNPGLLETAEGCRQI
LGQLQPSLQTGSEELRSLYNTIATLYCVHQRIEIKDTKEALEKIEEEQNKSKKKAQQTAA
DTGNNSQVSQNYPIVQNLQGQMVHQPISPRTLNAWVKVVEEKAFSPEVIPMFSALAEGAT
PQDLNTMLNTVGGHQAAMQMLKETINEEAAEWDRLHPVHAGPVAPGQIREPRGSDIAGTT
SNLQEQIGWMTSNPPIPVGEIYKRWIILGLNKIVRMYSPISILDIRQGPKEPFRDYVDRF
YRTLRAEQASQDVKNWMTETLLVQNANPDCKTILKALGPGATLEEMMTACQGVGGPGHKA
RVLAEAMSQVTNSATVMMQRGNFRNQRRTVKCFNCGKEGHIARNCRAPRKKGCWKCGQEG
HQMKDC-TERQANFLGKIWPSYKG-RPGNFLQSRP------------------EPTAP
PAESFRFGEETTTPPQKQEPIDKELYPLTSLKSLFGNDPSSQ
>gagB.syn6.2
MGARASVLSGGKLDRWEKIRLRPGGKKKYRLKHVVWASRELERFAVNPGLLESSEGCRQI
LEQLQPSLQTGSEELRSLFNTVATLYCVHQRIDVKDTKEALDKIEEEQNKCKKKAQQAAA
DTGNNSQVSQNYPIVQNLQGQMVHQPISPRTLNAWVKVVEEKAFSPEVIPMFAALSEGAT
PQDLNTMLNTVGGHQAAMQMLKETINEEAAEWDRVHPVHAGPIAPGQMREPRGSDIAGST
STLQEQIGWMTNNPPIPVGDIYKRWIILGLNKIVRMYSPASILDIRQGPKEPFRDYVDRF
YKTLRAEQATQEVKNWMTETLLVQNANPDCRTILKALGPGATLEEMMTACQGVGGPGHKA
RVLAEAMSQMTNSATIMMQKGNFRNQRKTIKCFNCGKEGHIARNCKAPRKKGCWKCGREG
HQMKDC-IERQANFLGKIWPSHKG-RPGNFLQNRP------------------EPTAP
PEESFRFGEETATPPQKQEPIDKELYPLASLKSLFGSDPSSQ
```

Fig. 9 cont'd-5

```
>gagB.syn6.3
MGARASVLSGGELDRWEKIRLRPGGKKKYRLKHLVWASRELERFAVNPGLLETSDGCRQI
LGQLQPALQTGSEELKSLYNTVATLYCVHQKIDVRDTKEALDKIEEEQNKSKQKAQQAAA
DTGNSSQVSQNYPIVQNIQGQMVHQAISPRTLNAWVKVVEEKAFSPEVIPMFTALSEGAT
PQDLNTMLNTVGGHQAAMQMLKETINEEAAEWDRLHPVQAGPVAPGQMREPRGSDIAGTT
STLQEQIGWMTHNPPIPVGEIYKRWIIMGLNKIVRMYSPSSILDIRQGPKESFRDYVDRF
YKVLRAEQASQEVKNWMTETLLVQNANPDCKTILKALGPGATLEEMMTACQGVGGPSHKA
RVLAEAMSQVTNSATIMMQRGNFRNQRKTVKCFNCGKEGHIAKNCRAPRKRGCWKCGKEG
HQMKEC-TERQANFLGKIWPSHKG-RPGNFLQSRP-----------------EPTAP
PEESFRFGEEKTTPSQKQETIDKELYPLASLRSLFGNDPSSQ
>gagB.syn6.4
MGARASVLSGGELDKWEKIRLRPGGKKKYQLKHIVWASRELERFAVNPGLLETSEGCKQI
LEQLQPALQTGSEELRSLYNTIAVLYCVHQKIEIKDTKEALDKVEEEQNKSKKKAQQAAA
GTGNSSQVSQNYPIVQNLQGQMVHQPLSPRTLNAWVKVVEEKAFSPEVIPMFTALSEGAT
PQDLNTMLNTVGGHQAAMQMLKETINEEAADWDRLHPVHAGPIAPGQMREPRGSDIAGST
STLQEQIGWMTHNPPIPVGDIYKRWIILGLNKIVRMYSPTSILDIKQGPKEPFRDYVDRF
YKTLRAEQATQEVKNWMTETLLVQNANPDCRTILKALGPAATLEEMMTACQGVGGPSHKA
RILAEAMSQVTNPATIMMQRGNFRNQRKPVKCFNCGKEGHIARNCRAPRKRGCWKCGKEG
HQMKDC-TERQVNFLGKIWPSHKG-RPGNFLQNRP-----------------EPSAP
PAESFRFGEETTTPSQKQEPIDKEMYPLASLRSLFGSDPSSQ
>gagB.syn6.5
MGARASVLSGGQLDRWEKIRLRPGGKKQYRLKHIVWASRELERFAINPGLLETSEGCRQI
LGQLQPSLQTGSEELKSLFNTVAVLYCVHQRIEVKDTKEALEKVEEEQNKSKKKAQQAAA
DTGNSSQVSQNYPIVQNLQGQMVHQALSPRTLNAWVKVIEEKAFSPEVIPMFSALSEGAT
PQDLNTMLNTVGGHQAAMQMLKDTINEEAAEWDRLHPVHAGPVAPGQMRDPRGSDIAGTT
STLQEQIAWMTNNPPIPVGEIYKRWIILGLNKIVRMYSPTSILDIRQGPKEPFRDYVDRF
YKVLRAEQASQDVKNWMTETLLVQNANPDCKTILKALGPAATLEEMMTACQGVGGPGHKA
RVLAEAMSQVTNSTTIMMQRGNFRNQRKIVKCFNCGKEGHLAKNCRAPRKKGCWKCGKEG
HQMKEC-TERQANFLGKIWPSHKG-RPGNFLQSRP-----------------EPSAP
PEESFRFGEETATPSQKQEPIDKDLYPLASLKSLFGNDPLSQ
>gagB.syn6.6
MGARASVLSGGKLDKWEKIRLRPGGKKKYKLKHIVWASRELERFALNPGLLETSEGCRQI
LRQLQPSLQTGSEELRSLYNTVATLYCVHQKIEVKDTKEALEKIEEEQNKSKKKAQQTAA
DTGNNSQVSQNYPIVQNMQGQMVHQALSPRTLNAWVKVVEEKAFSPEVIPMFSALSEGAT
PQDLNTMLNTVGGHQAAMQMLKDTINEEAAEWDRLHPAQAGPIAPGQIREPRGSDIAGTT
SNLQEQIAWMTHNPPIPVGDIYKRWIILGLNKIVRMYSPVSILDIRQGPKEPFRDYVDRF
YKTLRAEQASQEVKNWMTETLLVQNSNPDCKTILKALGPGATLEEMMTACQGVGGPGHKA
RVLAEAMSQVTNPATIMMQKGNFKNQRKTVKCFNCGKEGHLARNCRAPRKKGCWRCGKEG
HQMKDC-NERQANFLGKIWPSHKG-RPGNFLQSRP-----------------EPTAP
PEESFRFGEETTTPAQKQEPIDKELYPLTSLRSLFGNDPSLQ
>gagC.syn1.1
MGARASILRGGKLDKWEKIRLRPGGKKHYMLKHLVWASRELERFALNPGLLETSEGCKQI
IKQLQPALQTGTEELRSLYNTVATLYCVHEKIEVRDTKEALDKIEEEQNKSQQKTQQAKA
ADG---KVSQNYPIVQNLQGQMVHQAISPRTLNAWVKVIEEKAFSPEVIPMFTALSEGAT
PQDLNTMLNTVGGHQAAMQMLKDTINEEAAEWDRLHPVHAGPIAPGQMREPRGSDIAGTT
STLQEQIAWMTSNPPIPVGDIYKRWIILGLNKIVRMYSPVSILDIKQGPKEPFRDYVDRF
FKTLRAEQATQDVKNWMTDTLLVQNANPDCKTILRALGPGATLEEMMTACQGVGGPSHKA
RVLAEAMSQ-ANNTNIMMQRSNFKGSKRIVKCFNCGKEGHIARNCRAPRKKGCWKCGKEG
HQMKDC-TERQANFLGKIWPSHKG-RPGNFLQSRPE------PTAPPA-------EPTAP
PAESFRFEE--TTPAPKQEPKDRE--PLTSLKSLFGSDPLSQ
>gagC.syn3.1
MGARASVLRGEKLDKWERIRLRPGGKKHYMLKHLVWASRELERFALNPSLLETSEGCKQI
IQQLQPALKTGTEELRSLFNTVATLYCVHAGIEVRDTKEALDKIEEEQNKCQQKTQQAKE
ADG---KVSQNYPIVQNLQGQMVHQALSPRTLNAWVKVIEEKAFSPEVIPMFTALSEGAT
```

Fig. 9 cont'd-6

```
PSDLNTMLNTVGGHQAAMQMLKDTINEEAAEWDRLHPVQAGPVAPGQMREPRGSDIAGTT
SNLQEQIAWMTGNPPVPVGDIYKRWIILGLNKIVRMYSPVSILDIRQGPKEPFRDYVDRF
FKTLRAEQSTQEVKNWMTETLLVQNANPDCKTILRALGPAASLEEMMTACQGVGGPSHKA
RVLAEAMSQ-ANSTNIMMQRGNFKGPKRIIKCFNCGKEGHLARNCRAPRKKGCWKCGKEG
HQMKDC-IERQANFLGKIWPSNKG-RPGNFLQNRPE------PTAPPVEPTAPPAEPTAP
PAESFKFEE--TTPAPKQEPKDRE--PLTSLRSLFGSDPLSQ
>gagC.syn3.2
MGARASILRGEKLDTWEKIRLRPGGRKHYMLKHIVWASRELEKFALNPGLLETSEGCKQI
MKQLQPALQTGTEELKSLYNTVATLYCVHEKIEVRDTKEAVDKIEEEQNKSQQKTQQAKA
ADE---KVSQNYPIVQNIQGQMVHQPISPRTLNAWVKVIEEKGFNPEVIPMFTALSEGAT
PQDLNTMLNTVGGHQAAMQMLKDTINDEAAEWDRLHPVHAGPIAPGQMREPRGSDIAGST
STLQEQITWMTSNPPVPVGEIYKRWIILGLNKIVRMYSPVSILDIKQGPKEPFRDYVDRF
FKVLRAEQATQDVKNWMTDTLLIQNANPDCKTILKALGPGASLEEMMTACQGVGGPGHKA
RVLAEAMSQ-ANNTNIMMQRSNFKGPKRIVKCFNCGKEGHIAKNCRAPRKKGCWKCGQEG
HQMKDC-TERQANFLGKIWPSQKG-RPGNFLQNRP----------------EPSAP
PAESFRFGE--TTPAPKQELKDRE--PLTSLKSLFGSDPLSQ
>gagC.syn3.3
MGARASILRGGKLDKWEKIRLRPGGKKRYMLKHLIWASRELERFALNPGLLETAEGCKQI
IKQLQPALQTGTEELRSLYNTVATLYCVHKRIDVRDTKEALDKIEEEQNKIQQKTQQAKA
ADG---KVSQNYPIVQNAQGQMVHQAISPRTLNAWVKVVEEKAFSPEIIPMFTALSEGAT
PQDLNSMLNAVGGHQAAMQMLKDTINEEAAEWDRVHPVHAGPVAPGQIREPRGSDIAGTT
STLQEQIAWMTSNPPIPVGDIYKRWIIMGLNKIVRMYSPVSILDIKQGPKESFRDYVDRF
FKTLRAEQATQEVKNWMTDTLLVQNANPDCKTILRALGPGATLEEMMTACQGVGGPSHKA
RVLAEAMSQ-TNSA-ILMQRSNFKGSKRIVKCFNCGKEGHIARNCRAPRKRGCWKCGKEG
HQMKEC-TERQANFLGKIWPSHKG-RPGNFLQSRP---------------EPTAP
PAESFRFEE--TTPAPKQESKDRE--PLISLKSLFGNDPLSQ >gagC.syn4.1
MGARASVLRGEKLDTWERIKLRPGGKKHYMIKHLVWASRELEKFALNPGLLETSEGCKQI
IQQLQPALKTGTEELKSLYNTVATLYCVHERIDVRDTKEALDKIEEEQNKIQQKTQQAKE
ADG---KVSQNYPIVQNAQGQMVHQALSPRTLNAWVKVVEEKAFSPEIIPMFTALSEGAT
PSDLNTMLNTIGGHQAAMQMLKDTINDEAAEWDRLHPVHAGPIAPGQIREPRGSDIAGTT
STLQEQITWMTSNPPVPVGEIYKRWIILGLNKIVRMYSPVSILDIKQGPKESFRDYVDRF
FKTLRAEQSTQEVKNWMTETLLVQNANPDCKTILKALGPGATLEEMMTACQGVGGPGHKA
RVLAEAMSQ-TNSA-ILMQRSNFKGSKRIVKCFNCGREGHIARNCKAPRKKGCWKCGKEG
HQMKDC-IERQANFLGKIWPSHKG-RPGNFLQNRPE------PTAPP--------EPTAP
PAESFRFGE--TTPAPKQEQKDRE--PLISLKSLFGSDPLLQ
>gagC.syn4.2
MGARASILRGEKLDKWERIRLRPGGKKHYMLKHLVWASRELDRFALNPGLLETSDGCKQI
IKQLHPALQTGTEELRSLFNTVATLYCVHAGIEVRDTKEAVDKIEEEQNKSQQKTQQAKA
ADE---KVSQNYPIVQNIQGQMVHQPISPRTLNAWVKVIEEKAFSPEVIPMFTALSDGAT
PQDLNTMLNTVGGHQAAMQMLKDTINEEAAEWDRIHPVHAGPVAPGQMRDPRGSDIAGST
STLQEQIAWMTNNPPVPVGDIYKRWIIMGLNKIVRMYSPVSILDIRQGPKEPFRDYVDRF
FRTLRAEQATQDVKNWMTDTLLIQNANPDCKTILRALGPGASLEEMMTACQGVGGPGHKA
RVLAEAMSQ-ANNTNIMMQKSNFKGPKRTVKCFNCGKEGHIARNCRAPRKRGCWKCGKEG
HQMKEC-TERQANFLGKIWPSQKG-RPGNFLQSRP----------------EPSAP
PAESFRFEE--TTPAPKQESKDRE--PLTSLKSLFGSDPSSQ
>gagC.syn4.3
MGARASILRGGKLDTWEKIRLRPGGKKRYMLKHLIWASRELERFALNPSLLETSEGCKQI
MKQLQPALQTGTEELRSLYNTVATLYCVHKGIKVQDTKEALDKIEEEQKKSQQKTQQAEA
ADK--GKVSQNYPIVQNLQGQMVHQPLSPRTLNAWVKVIERKAFSPEVIPMFSALSEGAT
PQDLNSMLNAVGGHQAAMQMLKDTINEEAAEWDRVHPVHAGPIAPGQMREPRGSDIAGTT
SNLQEQIAWMTSNPPIPVGDIYKRWIVLGLNKIVRMYSPVSILDIKQGPKEPFRDYVDRF
FKTLRAEQATQEVKNWMTDTLLVQNANPDCKTILRALGPAASLEEMMTACQGVGGPGHKA
```

Fig. 9 cont'd-7

```
RVLAEAMSQ-ANS-NIMMQRGNFKGPKRIIKCFNCGKEGHLARNCRAPRKKGCWKCGREG
HQMKDC-TERQANFLGKIWPSNKG-RPGNFLQSRP------------------EPTAP
PAESFGFGE--TTPAPKQELKDRE--PLTSLKSLFGNDPLSQ
>gagC.syn4.4
MGARASILRGGKLDKWEKIRLRPGGRKHYMLKHIVWASRELERFALNPGLLETAEGCKQI
IKQLQPALQTGTEELKSLFNTVATLYCVHEKIEVRDTKEALDKIEEEQNKCQQKTQQAKA
ADG---KVSQNYPIVQNLQGQMVHQAISPRTLNAWVKVIEEKGFNPEVIPMFTALSEGAA
PQDLNTMLNTIGGHQAAMQMLKDTINEEAAEWDRLHPVQAGPVAPGQMREPRGSDIAGTT
SSLQEQIAWMTGNPPVPVGDIYKRWIILGLNKIVRMYSPVSILDIRQGPKEPFRDYVDRF
FKVLRAEQATQDVKNWMTETLLVQNANPDCKTILRALGPGATLEEMMTACQGVGGPSHKA
RVLAEAMSQ-ANNANIMMQRSNFKGPKRIVKCFNCGKEGHIAKNCRAPRKKGCWKCGQEG
HQMKDC-NERQANFLGRIWPSHKG-RPGNFIQSRPEPTAPLEPTAPPA-------EPTAP
PAESFKFEE--TTPAPKQEPKDRE--PLTSLRSLFGSDPLSQ >gagC.syn6.1
MGARASVLRGEKLDTWERIKLRPGGKKHYMIKHLVWASRELEKFALNPGLLETAEGCKQI
IRQLQPALQTGTEELRSLYNTVATLYCVHKRIDVRDTKEALDKIEEEQNKSQQKAQQAKA
ADG---KVSQNYPIVQNLQGQMVHQSLSPRTLNAWVKVIERKAFSPEVIPMFSALSEGAT
PQDLNTMLNTVGGHQAAMQMLKDTINEEAAEWDRIHPVHAGPIAPGQMREPRGSDIAGTT
STLQEQITWMTSNPPVPVGEIYKRWIILGLNKIVRMYSPVSILDIRQGPKEPFRDYVDRF
FKTLRAEQSTQEVKNWMTDTLLAQNANPDCKIILRGLGPGATLEEMMTACQGVGGPGHKA
RVLAEAMSQ-ANS-NILMQRSNFKGPRRTIKCFNCGKEGHLAKNCRAPRKKGCWKCGKEG
HQMKEC-TERQANFLGKIWPSQKG-RPGNFLQSRP------------------EPSAP
PAESFRFEE--TTPALKQEPKDRE--PLTSLRSLFGSDPLSQ
>gagC.syn6.2
MGASASILRGEKLDRWEKIRLRPGGKKCYMLKHIIWASKELERFALNPGLLETSEGCKQI
MKQLQPALQTGTEELKSLYNTVATLYCVHEKIEVRDTKEALDKIEEEQKKSQQKTQQAEA
ADK--GKVSQNYPIVQNAQGQMVHQALSPRTLNAWVKVVEEKAFSPEIIPMFTALSEGAA
PQDLNTMLNTVGGHQAAMQMLKDTINEEAAEWDRVHPVHAGPIAPGQIREPRGSDIAGTT
STLQEQVAWMTSNPPVPVGDIYKRWIVLGLNKIVRMYSPVSILDIKQGPKEPFRDYVDRF
FKTLRAEQSSQEVKNWMTDTLLVQNANPDCKTILRALGPAASLEEMMTACQGVGGPSHKA
RVLAEAMSQ-ANSTNIMMQRGNFKGPKRIVKCFNCGREGHIARNCRAPRKKGCWKCGQEG
HQMKDC-IERQANFLGKIWPSHKG-RPGNFIQSRPE------PTAPP--------EPTAP
PAESFRFGE--TTPAPKQESKDRE--PLTSLKSLFGNDPLSQ
>gagC.syn6.3
MGARASVLKGEKLDKWERIRLRPGGKKQYRLKHLVWASRELERFALNPSLLETSEGCRQI
IKQLQPALKTGTEELRSLYNTIATLYCVHKGIKVQDTKEALDKVEEEQNKSQQKTQQAKA
ADE---KVSQNYPIVQNLQGQMVHQPLSPRTLNAWVKVIEEKGFNPEVIPMFTALSEGAT
PQDLNSMLNAVGGHQAAMQMLKDTINEEAAEWDRLHPVQAGPVAPGQIREPRGSDIAGTT
SSLQEQIAWMTGNPPVPVGDIYKRWIILGLNKIVRMYSPVSILDIKQGPKESFRDYVDRF
FKTLRAEQATQDVKNWMTETLLVQNANPDCKTILRALGPGATLEEMMTACQGVGGPSHKA
RVLAEAMSQ-ANNANIMMQRSNFKGPKRTVKCFNCGKEGHIAKNCRAPRKKGCWKCGREG
HQMKDC-IERQANFLGKIWPSNKG-RPGNFLQNRTE------PTAPPA-------EPTAP
PAESFRFEE--TTPAPKQELKDRE--PLTSLKSLFGSDPLLQ
>gagC.syn6.4
MGARASILRGEKLDKWEKIRLRPGGRKHYMLKHIVWASRELEGFALNPGLLETSEGCKQI
IKQLQPALQTGTEELRSLFNTVATLYCVHSGIEVRDTKEAVDKIEEEQNKIQQKTQQAKE
ADG---KVSQNYPIVQNSQGQMVHQAISPRTLNAWVKVIEEKAFSPEVIPMFTALSEGAT
PSDLNTMLNTIGGHQAAMQMLKDTINDEAAEWDRLHPVHAGPIAPGQMRDPRGSDIAGST
STLQEQIAWMTNNPPVPVGDIYKRWIIMGLNKIVRMYSPVSILDIKQGPKEPFRDYVDRF
FRTLRAEQATQEVKNWMTETLLVQNANPDCRTILKALGPGATLEEMMTACQGVGGPGHKA
RVLAEAMSQ-ANNINIMMQRNNFKGPKRIIKCFNCGKEGHIARNCKAPRKKGCWKCGKEG
HQMKDC-NERQANFLGKIWPSHKG-RPGNFLQNRP------------------EPTAP
PAESFRFEE--TTPTPKQEPKDRE--PLTSLKSLFGSDPSSQ
```

Fig. 9 cont'd-8

```
>gagC.syn6.5
MGARASILRGGKLDKWEKIRLRPGGKKRYMLKHLIWASRELERFALNPGLLETSDGCKQI
IQQLQPALKTGTEELKSLFNTVAVLYCVHKGIEVRDTKEAVDKIEEEQNKIQQKMQQQKV
TDG---KVSQNYPIVQNIQGQMVHQPISPRTLNAWVKVIEEKGFSPEVIPMFTALSEGAT
PSDLNTMLNTVGGHQAAMQMLKDTINEEAAEWDRTHPVHAGPVAPGQMREPRGSDIAGTT
STLQEQIGWMTNNPPIPVGEIYKRWIILGLNKIVRMYSPVSILDIKQGPKEPFRDYVDRF
FKALRAEQATQEVKGWMTDTLLVQNANPDCKTILKALGSGATLEEMMTACQGVGGPGHKA
RVLAEAMSQ-ANNTNIMMQKSNFKGPRRIVKCFNCGREGHIAKNCRAPRKKGCWKCGQEG
HQMKDC-TERQANFLGRIWPSHKG-RPGNFLQSRPE------PTAPL--------QPTAP
PAESFKFEE--TTPAPKQEQKDRE--PLTSLRSLFGNDPLSQ
>gagC.syn6.6
MGARASILRGGKLDTWEKIRLRPGGKKHYMLKHLVWASRELDRFALNPGLLETADGCKQI
IKQLHPALQTGTEEIKSLFNTVATLYCVHAGIEVRDTKEALDKIEEEQNKCQQKTQQAKE
ADK---KVSQNYPIVQNLQGQMVHQAISPRTLNAWVKVIEEKAFNPEIIPMFTALSDGAT
PQDLNTMLNTVGGHQAAMQMLKDTINEEAADWDRLHPVHAGPVAPGQLREPRGSDIAGTT
SNLQEQIAWMTSNPPIPVGDIYKRWIILGLNKIVRMYSPVSILDIKQGPKEPFRDYVDRF
FKVLRAEQATQDVKNWMTDTLLIQNANPDCKTILRALGPGASLEEMMTACQGVGGPSHKA
RVLAEAMSQ-TNSA-ILMQRSNFKGSKRIVKCFNCGKEGHLARNCRAPRKRGCWKCGKEG
HQMKDCTTERQANFLGKIWPSHKGGRPGNFLQNRPE------PTAPL--------EPTAP
PAESFGFGE--TTPAPKQEPKDRE--PLISLKSLFGSDPLSQ >gagM.syn1.1
MGARASILRGGKLDKWEKIRLRPGGKKHYMLKHLVWASRELERFALNPGLLETSEGCKQI
IKQLQPALQTGTEELRSLFNTVATLYCVHEKIEVRDTKEALDKIEEEQNKSQQKTQQAKA
ADG---KVSQNYPIVQNLQGQMVHQAISPRTLNAWVKVIEEKAFSPEVIPMFTALSEGAT
PQDLNTMLNTVGGHQAAMQMLKDTINEEAAEWDRLHPVHAGPIAPGQMREPRGSDIAGTT
STLQEQIAWMTSNPPIPVGEIYKRWIILGLNKIVRMYSPVSILDIRQGPKEPFRDYVDRF
FKTLRAEQATQDVKNWMTDTLLVQNANPDCKTILRALGPGATLEEMMTACQGVGGPSHKA
RVLAEAMSQ-ANNTNIMMQRSNFKGSKRIVKCFNCGKEGHIARNCRAPRKKGCWKCGKEG
HQMKDC-TERQANFLGKIWPSHKG-RPGNFLQSRPE------PTAPPA--------EPTAP
PAESFRFEE--TTPAPKQEPKDRE--PLTSLKSLFGSDPLSQ >gagM.syn3.1
---RASVLSGGKLDAWEKIRLRPGGKKKYKLKHIVWASRELERFAVNPGLLETSEGCRQI
LGQLQPSLQTGSEELRSLYNTVAVLYCVHQRIEVKDTKEALEKIEEEQNKSKKKAQQAAA
DTGNSSQVSQNYPIVQNLQGQMVHQAISPRTLNAWVKVIEEKAFSPEVIPMFTALSEGAT
PSDLNTMLNTIGGHQAAMQILKDTINEEAAEWDRLHPVHAGPIAPGQMREPRGSDIAGTT
STLQEQIGWMTNNPPIPVGEIYKRWIILGLDKIVRMYSPTSILDIRQGPKESFRDYVDRF
YKTLRAEQASQEVKNWMTETLLVQNANPDCKTILKALGPAATLEEMMTACQGVGGPSHKA
RILAEAMSQVTNSATIMMQRGNFRNQRKTVKCFNCGKEGHIAKNCRAPRKKGCWKCGKEG
HQMKDC-NERQANFLGKIWPSHKG-RPGNFLQSRP-----------------EPTAP
PEESFRFGEETTTPSQKQEPIDKELYPLASLKSLFGNDPLSQ
>gagM.syn3.2
MGARASILRGGKLDKWEKIRLRPGGKKHYMLKHLVWASRELERFALNPGLLETAEGCKQI
IKQLQPALKTGTEELKSLYNTVATLYCVHEKIEVRDTKEALDKLEEEQNKSQQKTQQAAA
GTGSSSKVSQNYPIVQNAQGQMVHQALSPRTLNAWVKVVEEKAFSPEVIPMFSALAEGAT
PQDLNTMLNTVGGHQAAMQMLKDTINEEAADWDRLHPVHAGPVAPGQMREPRGSDIAGST
STLQEQIAWMTSNPPIPVGDIYKRWIILGLNKIVRMYSPVSILDIKQGPKEPFRDYVDRF
FKTLRAEQATQDVKNWMTDTLLVQNANPDCKTILRALGPGASLEEMMTACQGVGGPGHKA
RVLAEAMSQ-ANNANIMMQRGNFKGQKR-IKCFNCGKEGHLARNCRAPRKKGCWKCGREG
HQMKDC-TERQANFLGRIWPSSKG-RPGNFPQSRP-----------------EPSAP
PAESFGFGE--TTPAPKQELKDRE--PLTSLKSLFGSDPLSQ
>gagM.syn3.3
MGARASVLSGGELDRWEKIRLRPGGKKKYRLKHLVWASRELEKFALNPGLLETSEGCKQI
MKQLQPALQTGTEELRSLFNTVATLYCVHQRIDVKDTKEALDKIEEEQNKIQQKTQQAKA
ADG---KVSQNYPIVQNIQGQMVHQPISPRTLNAWVKVVEEKGFNPEVIPMFSALSEGAT
```

Fig. 9 cont'd-9

```
PQDLNMMLNIVGGHQAAMQMLKETINEEAAEWDRVHPVHAGPIPPGQMREPRGSDIAGTT
SNLQEQIGWMTSNPPVPVGDIYKRWIVLGLNKIVRMYSPVSILDIRQGPKEPFRDYVDRF
FKVLRAEQATQEVKNWMTDTLLIQNANPDCKSILRALGPGATLEEMMTACQGVGGPSHKA
RVLAEAMSQ-TNSA-ILMQRSNFKGSKRIVKCFNCGKEGHIARNCRAPRKRGCWKCGQEG
HQMKDC-TERQVNFLGKIWPSNKG-RPGNFLQNRPE------PTAPPA-------EPTAP
PAESFRFEE--TTPAPKQEPKDRE--PLTSLRSLFGNDPSSQ

>gagM.syn4.1
MGARASVLSGGELDRWEKIRLRPGGKKKYKLKHIVWASRELERFAVNPGLLETSEGCRQI
LGQLQPSLQTGSEELRSLYNTVAVLYCVHQRIDVKDTKEALEKIEEEQNKSQQKTQQAKA
ADG---KVSQNYPIVQNAQGQMVHQAISPRTLNAWVKVIEEKGFSPEVIPMFSALAEGAT
PQDLNTMLNTIGGHQAAMQMLKDTINDEAAEWDRLHPVQAGPVAPGQIREPRGSDIAGTT
SNLQEQIGWMTSNPPIPVGDIYKRWIIMGLNKIVRMYSPTSILDIRQGPKESFRDYVDRF
FRTLRAEQASQEVKNWMTETLLVQNSNPDCKTILKALGPAATLEEMMTACQGVGGPGHKA
RVLAEAMSQ-VQQPNIMMQRGNFKGQKR-IKCFNCGREGHLARNCRAPRKKGCWKCGREG
HQMKDC-TESKANFLGKIWPSNKG-RPGNFLQSRP------------------EPSAP
PAESFGFGEE-ITPSQKQEQKDKELYPLASLKSLFGNDPLSQ
>gagM.syn4.2
MGARASVLSGGKLDAWEKIRLRPGGKKKYRLKHLVWASRELDRFALNPSLLETAEGCKQI
MKQLQPALKTGTEELKSLYNTVATLYCVHEKIDVRDTKEALDKIEEEQNKIQQKTQQAKE
ADG---KVSQNYPIVQNIQGQMVHQPISPRTLNAWVKVVEEKAFSPEVIPMFTALSDGAT
PQDLNSMLNAVGGHQAAMQILKDTINEEAADWDRLHPVHAGPVAPGQMREPRGSDIAGTT
STLQEQIGWMTNNPPIPVGEIYKRWIILGLNKIVRMYSPVSILDIKQGPKESFRDYVDRF
FKVLRAEQATQDVKNWMTDTLLIQNANPDCKSILRALGPGATLEEMMTACQGVGGPSHKA
RILAEAMSQVTNSATIMMQRGNFRNQRKTVKCFNCGKEGHLARNCKAPRKRGCWKCGKEG
HQMKEC-TERQANFLGKIWPSSKG-RPGNFPQSRP------------------EPTAP
PEESFRFGEETTTPSQKQEPIDKELYPLASLRSLFGNDPSSQ
>gagM.syn4.3
MGARASILRGGKLDKWEKIRLRPGGKKRYMLKHLIWASRELERFALNPGLLETAEGCQQI
IEQLQSTLKTGSEELKSLFNTVATLYCVHQRIEVKDTKEALDKVEEEQNKSKKKAQQAAA
DTGNSSQVSQNYPIVQNLQGQMVHQALSPRTLNAWVKVIEEKAFSPEIIPMFTALSEGAT
PSDLNTMLNTVGGHQAAMQMLKDTINEEAAEWDRVHPVHAGPIPPGQMREPRGSDIAGTT
SSLQEQIAWMTSNPPVPVGEIYKRWIVLGLNKIVRMYSPVSILDIRQGPKEPFRDYVDRF
FKTLRAEQASQDVKNWMTETLLVQNANPDCKTILRALGPGASLEEMMTACQGVGGPSHKA
RVLAEAMSQ-TNSA-ILMQRSNFKGSKRIVKCFNCGKEGHIARNCRAPRKRGCWKCGQEG
HQMKDC-NERQANFLGKIWPSHKG-RPGNFLQNRPE------PTAPP--------EPTAP
PAESFRFEE--TTPAPKQELKDRE--PLTSLKSLFGSDPLSQ
>gagM.syn4.4
MGARASVLRGEKLDKWERIRLRPGGKKHYMLKHLVWASRELEKFALNPGLLETSEGCKQI
IKQLQPALQTGTEELRSLFNTVATLYCVHAGIEVRDTKEALDKIEEIQNKSKQKTQQAAA
GTGSSSKVSQNYPIVQNLQGQMVHQPLSPRTLNAWVKVVEEKGFNPEVIPMFSALSEGAT
PQDLNMMLNIVGGHQAAMQMLKETINEEAAEWDRLHPVHAGPIAPGQMREPRGSDIAGST
STLQEQIAWMTGNPPVPVGDIYKRWIILGLNKIVKMYSPTSILDIKQGPKEPFRDYVDRF
YKTLRAEQATQEVKNWMTDTLLVQNANPDCKSILKALGTGATLEEMMSACQGVGGPAHKA
RVLAEAMSQ-ANNTNIMMQRSNFKGPKRIIKCFNCGKEGHIAKNCRAPRKKGCWKCGKEG
HQMKDC-TERQANFLGRIWPSSKG-RPGNFLQSRPE------PTAPPA-------EPTAP
PAESFKFEE--TTPAPKQEPKDRE--PLTSLRSLFGSDPLLQ >gagM.syn6.1
MGARASILSGGKLDAWEKIRLRPGGRKHYMLKHIVWASRELERFALNPGLLETAEGCQQI
IEQLQSTLKTGSEELKSLFNTVATLWCVHQRIEVKDTKEALDKLEEEQNKSQQKTQQAKA
ADG---KVSQNYPIVQNLQGQMVHQSISPRTLNAWVKAIEEKAFSPEVIPMFSALAEGAT
PQDLNTMLNTIGGHQAAMQILKDTINEEAAEWDRIHPVHAGPVAPGQMRDPRGSDIAGTT
SNLQEQIAWMTSNPPVPVGEIYKRWIILGLDKIVRMYSPVSILDIRQGPKEPFRDYVDRF
FKTLRAEQATQEVKGWMTDTLLVQNANPDCKTILKALGPGATLEEMMSACQGVGGPGHKA
```

Fig. 9 cont'd-10

```
RVLAEAMSQ-ANNTNIMMQKSNFKGPKRIIKCFNCGKEGHLARNCRAPRKKGCWKCGQEG
HQMKDC-TERQANFLGRIWPSHKG-RPGNFPQSRL------------------EPTAP
PAESFGFGEE-IAPSPKQEPKEKELYPLTSLKSLFGNDPLSQ
>gagM.syn6.2
MGARASILRGGKLDKWEKIRLRPGGKKKYKLKHIVWASRELEKFALNPGLLETSEGCRQI
LGQLQPSLQTGSEELKSLYNTVATLYCVHQRIDVKDTKEALEKIEEEQNKSQQKTQQAAA
DKG----VSQNYPIVQNLQGQMVHQAISPRTLNAWVKVIEEKAFSPEIIPMFTALSEGAT
PQDLTTMLNTVGGHQAAMQMLKETINDEAAEWDRLHPVHAGPVAPGQLREPRGSDIAGST
STLQEQIAWMTGNPPVPVGDIYKRWIVLGLNKIVRMYSPTSILDIRQGPKEPFRDYVDRF
YKTLRAEQASQDVKNWMTETLLVQNANPDCRTILKALGPAATLEEMMTACQGVGGPAHKA
RVLAEAMSQVTNPATIMMQRGNFRNQRKTVKCFNCGKEGHLAKNCRAPRKRGCWKCGKEG
HQMKDC-NERQANFLGKIWPSNKG-RPGNFLQNRT------------------EPTAP
PAESFRFGEEKTTPSQKQEPIDKELYPLASLRSLFGNDPSLQ
>gagM.syn6.3
MGARASVLRGEKLDKWERIRLRPGGKKRYMLKHLIWASRELERFALNPSLLETSEGCKQI
IQQLQPALKTGTEELRSLYNTVATLYCVHEKIEVRDTKEAVDKIEEEQNKSKKKAQQAAA
DTGNSSQVSQNYPIVQNIQGQMVHQALSPRTLNAWVKVVEEKGFNPEVIPMFSALSEGAT
PQDLNMMLNIVGGHQAAMQMLKDTINEEAAEWDRLHPVQAGPVAPGQMREPRGSDIAGTT
STLQEQITWMTSNPPIPVGEIYKRWIIMGLNKIVRMYSPVSILDIKQGPKESFRDYVDRF
FRTLRAEQASQEVKNWMTETLLIQNANPDCKTILRALGPAASLEEMMTACQGVGGPGHKA
RVLAEAMSQ-TNSA-ILMQRSNFKGSKRIVKCFNCGKEGHIARNCRAPRKKGCWRCGKEG
HQMKDC-TESKANFLGKIWPSHKG-RPGNFLQNRPEPTAPPEPTAPPAEPTAPPAEPTAP
PAESFKFEE--TTPAPKQELKDRE--PLISLKSLFGSDPLLQ
>gagM.syn6.4
MGARASILRGEKLDTWEKIRLRPGGKKQYRLKHIVWASRELDRFALNPSLLETAEGCKQI
IKQLHPALQTGTEELRSLFNTVATLYCVHAGIEVRDTKEALDKIEEEQNKIQQKTQQAKA
ADE---KVSQNYPIVQNMQGQMVHQPLSPRTLNAWVKVVEEKAFSPEVIPMFAALSEGAT
PSDLNTMLNTVGGHQAAMQMLKDTINDEAAEWDRLHPAQAGPIPPGQIREPRGSDIAGTT
STPQEQIGWMTNNPPIPVGEIYKRWIVLGLNKIVRMYSPISILDIRQGPKEPFRDYVDRF
FKALRAEQATQEVKGWMTETLLVQNSNPDCKTILRALGPGASLEEMMTACQGVGGPSHKA
RILAEAMSQ-ANS-NIMMQRSNFKGPKRIVKCFNCGKEGHIAKNCRAPRKKGCWKCGREG
HQMKDC-IERQANFLGKIWPSQKG-RPGNFLQSRP------------------EPSAP
PAESFRFGE--TTPAPKQEPKDRE--PLTSLRSLFGSDPLSQ
>gagM.syn6.5
MGARASVLSGGELDRWEKIRLRPGGKKKYRLKHLVWASRELERFAINPGLLETSDGCKQI
IKQLQPALQTGSEELRSLYNTIATLYCVHQKIEVKDTKEALDKIEEIQNKSKQKTQQAAA
GTGSSSKVSQNYPIVQNAQGQMVHQSLSPRTLNAWVKVIEEKGFNPEVIPMFTALSEGAT
PHDLNTMLNTVGGHQAAMQMLKETINEEAAEWDRVHPVHAGPIPPGQMREPRGSDIAGST
STLQEQIGWMTSNPPIPVGDIYKRWIILGLNKIVRMYSPSSILDIRQGPKESFRDYVDRF
FKCLRAEQATQEVKNWMTDTLLIQNANPDCKSILRALGPGATLEEMMTACQGVGGPGHKA
RILAEAMSQ-VQQPNIMMQRGNFKGQKR-IKCFNCGREGHIARNCKAPRKKGCWKCGKEG
HQMKDC-TERQVNFLGKIWPSYKG-RPGNFLQSRP------------------EPTAP
PEESFRFGEETTTPSQKQETIDKELYPLASLKSLFGNDPSSQ
>gagM.syn6.6
MGARASVLSGGKLDAWERIRLRPGGKKHYMLKHLVWASRELERFAVNPGLLETSEGCKQI
MKQLQPALQTGTEELKSLYNTVAVLYCVHQRIEIKDTKEALDKIEEEQNKCQQKTQQAKE
ADG---KVSQNYPIVQNLQGQMVHQPISPRTLNAWVKVIEEKGFSPEVIPMFTALSDGAT
PQDLNSMLNAVGGHQAAMQMLKDTINEEAADWDRLHPVHAGPIAPGQMREPRGSDIAGTT
SSLQEQIAWMTNNPPVPVGEIYRRWIILGLNKIVKMYSPTSILDIKQGPKEPFRDYVDRF
FKVLRAEQATQDVKNWMTDTLLVQNANPDCKSILKALGTGATLEEMMTACQGVGGPSHKA
RVLAEAMSQVTNSATIMMQKGNFRNQRKIVKCFNCGREGHLARNCKAPRKRGCWKCGKEG
HQMKEC-TERQANFLGKIWPSSKG-RPGNFPQSRP------------------EPTAP
PAESFRFEE--TTPAPKQESKDRE--PLTSLKSLFGSDPSSQ
```

Fig. 10

```
>ENV-B.syn1.1
MRVTGIRKNYQHLWRWGTMLLWRWGTMLLGMLMICSATEKLWVTVYYGVPVWKEATTTLF
CASDAKAYDTEVHNVWATHACVPTDPNPQEVVLENVTENFNMWKNNMVEQMHEDIISLWD
QSLKPCVKLTPLCVTLNCTDDVRNVT-NNATNTNSSW-GEPMEKGEIKNCSFNITTSIRD
KVQKEYALFYKLDVVPI-DNDSNNTN--------YRLISCNTSVITQACPKVSFEPIPIH
YCAPAGFAILKCNDKKFNGTPCTNVSTVQCTHGIRPVVSTQLLLNGSLAEEEVVIRSEN
FTNNAKTIMVQLNVSVEINCTRPNNNTRKSIHIGPGRAFYTTGDIIGDIRQAHCNISRAQ
WNNTLKHIVEKLGKQFGNNKTIVFNHSSGGDPEIVMHSFNCGGEFFYCNSTKLFNSTWTR
N-NGTWTRN---DTERSNSTE---EHITLPCRIKQIINMWQEVGKAMYAPPIRGQIRCSS
NITGLLLTRDGGNDT-----SGTEIFRPGGGDMRDNWRSELYKYKVVKIEPLGVAPTKAK
RRVVQREKRAVG-IGAVFLGFLGAAGSTMGAASMTLTVQARQLLSGIVQQQNNLLRAIEA
QQHLLQLTVWGIKQLQARVLAVERYLRDQQLLGIWGCSGKLICTTAVPWNASWSNKSLNE
IWNNMTWMEWEKEIDNYTNLIYNLLEESQNQQEKNEQELLELDKWASLWNWFDISNWLWY
IKIFIMIVGGLVGLRIVFAVLSIVNRVRQGYSPLSFQTRLPAPRGPDRPEGIEEEGGERD
RDRSVRLVDGFLALIWDDLRSLCLFSYHRLRDLLLIVTRIVELLG------RRGWEALK
YWWNLLQYWSQELKNSAVSLLNATAIAVAEGTDRVIEALQRACRAILHIPRRIRQGLERA
LL-
>ENV-B.syn3.1
MRVKETRKNYQHLWKWGTML--------LGMLMICSATEKLWVTVYYGVPVWRDANATLF
CASDAKAYDTEAHNVWATHACVPTDPNPQEVELKNVTENFNMWKNDMVEQMHEDIINLWD
QSLKPCVELTPLCVTLNCTDYVKNIT-NNATSTNSSW-GKPMEKGEIKFCSFNITTSIRN
KVQKQYALFYKLDIVPI-DNDNTS---------YRLISCNTSTITQACPKVTFEPIPIH
YCAPAGFAILKCNNKTFNGTPCTNVSTVQCTHGIRPVISTQLLLNGSLAEEEVVIRSEN
FTNNAKTIMVQLNVSVEINCTRPNNNTRRSIPIGPGRVFYTTEDIIGDIRQAHCNISRAQ
WNNTLKHIVEKLGKQFGNNKTIVFNHSSGGDPEIVMHSFNCRGEFFYCKSTKLFNSTWTR
N-NGTWTRN---DTERSNSTE---EHITLPCRIKQIINMWQEVGKAMYAPPIKGQISCSS
NITGLLLTRDGGNDT-----SGTEIFRPGGGDMRDNWRSELYKYKVVRIEPLGVAPTEAK
RRVVQREKRAVG-IGAVFLGFLGAAGSTMGAASMTLTVQARLLLSGIVQQQSNLLRAIEA
QQHMLQLTVWGIKQLQARLLAVERYLGDQQLLGLWGCSGKLICTTTVPWNTSWSNKSLNE
IWDNMTWMQWEREIDNYTGLIYNLLEKSQNQQEKNEQELLELDKWASLWNWFDITNWLWY
IKIFIMIVGGLVGLRIVFTVLSIVNRVRKGYSPLSFQTRLPTPRGPDRPGGIEEEGGEQD
RDRSGPLVNGFLALIWDDLRSLFLFSYHRLRDLLLIVARIVELLG------RRGWEILK
YWWNLLLYWSQELKNSAVSLLNATAIAVAEGTDRVIEVVQRAFRAILHIPRRIRQGFERA
LL-
>ENV-B.syn3.2
MRVTGIRKNYQHLWRWGTMLLWRWGTMLLGILMICSAAGKLWVTVYYGVPVWKEANTTLF
CASDAKAYDTEVHNVWATHACVPIDPNPQEVVLGNVTENFNMWKNNMVEQMHEDIISLWD
ESLKPCVKLTPICVTLNCTDDVRNVT-NNATNTNSSW-GEPMEKGEIKNCSFNITTSIRD
KVQKQYALFYKLDVVPI-DNDSNNTN--------YRLISCNTSVITQACPKISFEPIPIH
FCAPAGFAILKCNDKKFNGTPCKNVSTVQCTHGIKPVVSTQLLLNGSLAEEEIVIRSEN
FTDNAKTIIVQLNESVVINCTRPNNNTRKSIHIGPGRAFYATGEIIGDIRQAHCNLSRAK
WNDTLKQIVIKLREQFG-NKTIVFNQSSGGDPEIVMHSFNCGGEFFYCNTTQLFNSTWTW
N-NSTW--N---NTKRSNDTE---EIITLPCRIKQIVNMWQKVGKAMYAPPIRGQIRCSS
NITGILLTRDGGNNNET---NRTETFRPGGGNMKDNWRSELYKYKVVKIEPLGIAPTKAR
RRVVQREKRAVGTIGAMFLGFLGAAGSTMGAASLTLTVQARQLLPGIVQQQNNLLKAIEA
QQHLLRLTVWGIKQLQARVLAVERYLRDQQLLGIWGCSGKIICTTAVPWNASWSNKSLDK
IWDNMTWMEWEKEIDNYTNLIYNLLEESQNQQEKNELELLELDKWANLWNWFDISNWLWY
IKIFIMIIGGLVGLRIVFAVLSIVNRVRQGYSPLSFQTRLPAPRGPDRPEGIEEEGGERD
RDRSVRLVDGFLALIWDDLRSLCLFLYHRLRDLLLIAARIVELLG------RRGWEALK
YWWNLLQYWSQELKNSAISLLNATAVAVAEGTDRVIEALQRACRAILHIPRRIRQGLERL
LL-
>ENV-B.syn3.3
MRVKGIRKNCQHLWRWGIML--------LGMLMICSAAEQLWVTVYYGVPVWKEATTTLF
CASDAKAYDKEVHNVWATHASVPTDPNPQEVVLENVTENFNMWKNNMVDQMHEDIISLWD
QSLKPCVKLTPLCVTLNCTD-LRNATNGNDTNTTSSS-REMMGGGEMKNCSFNVTTSIRD
KVQKEYALFYKLDVIPI-DSRNNSNNSTE--YNSYRLINCNTSVITQACPKVSFEPIPIH
```

Fig. 10 cont'd-1

```
YCTPAGFAILKCKDKKFNGTGPCTKVSTVQCTHGIRPVVSTQLLLNGSLAEEEVIIRSEN
FTNNAKTIIVQLKEAVEINCTRPSNNTRKSIPIGPGRAFYTTGDIIGDIRKAHCNISRAN
WNNTLRQIVEKLGEQFGNNKTIIFKQSSGGDPEIVTHSFNCGGEFFYCNSTQLFNSTWNF
--NGTWNKN---FNNTWNNTEGTNDTITLPCRIKQIINRWQEVGKAMYAPPISGQIRCSS
NITGLILTRDGGNNGNET--NGTEIFRPGGGNMRDNWRSELYRYKVVKIEPLGVAPTKAK
RRVVQREKRAVG-IGALFLGFLGAAGSTMGAASITLTVQARQLLSGIVQQQNNLLRAIEA
QQHLLQLTVWGIKQLQARILAVERYLKDQQLLGIWCSGKLICTTAVPWNTSWSNRSLNE
IWNNMTWMEWEREIDNYTSLIYTLIEESQNQQEKNEQELLALDKWASLWNWFSITNWLWY
IRIFIMIVGGLIGLRIVFAVLSVVNRVRQGYSPLSFQTHLPAQRGPDRPEGTEEEGGERD
RDRSGRLVDGFLAIIWVDLRSLCLFSYHRLRDLLLIVTRIVELLG-------RRGWEVLK
YWWNLLQYWIQELKNSAVSLFNAIAIAVAEGTDRIIEVVQRAYRAILHIPTRIRQGLERA
LL-

>ENV-B.syn4.1
MRVTGIRKNYQHLWRWGTMLLWRWGTMLLGILMICSAAGKLWVTVYYGVPVWKDATTTLF
CASDAKAYDTEVHNVWATHASVPTDPNPQEVVLENVTEDFNMWKNNMVDQMHEDIISLWD
QSLKPCVELTPLCVTLNCTDDVRNVT-NNATNTNSSW-GEPMEKGEIKFCSFNITTSIRN
KVQKQYALFYKLDVVPI-DNDSNNTN--------YRLISCNTSVITQACPKVTFEPIPIH
YCAPAGFAILKCNNKTFNGTGPCTKVSTVQCTHGIRPVVSTHLLLNGSLAEEEVIIRSEN
FTDNTKTIIVQLKEAVEINCTRPNNNTRKGIHIGPGRAFYTTGEIIGDIRQAHCNLSRAK
WNDTLKQIVIKLREQFG-NKTIIFNQSSGGDPEIVMHTFNCGGEFFYCNTTQLFNSTW--
--------QN---ETSGSINITDIGENITLPCRIKQIVNMWQKVGKAMYAPPIKGQISCSS
NITGLLLTRDGGNNGNET--NGTEIFRPGGGNMKDNWRSELYRYKVVKIEPLGVAPTRAK
RRVVQREKRAVT-LGAMFLGFLGAAGSTMGAASMTLTVQARLLLSGIVQQQSNLLRAIEA
QQHLLRLTVWGIKQLQARILAVERYLQDQQLLGIWCSGKLICTTAVPWNASWSNKSQDE
IWNNMTWMQWEKEIDNYTGLIYTLLEESQIQQEKNEQELLELDKWASLWNWFDITNWLWY
IKIFIMIVGGLIGLRIVFTVLSIVNRVRKGYSPLSFQTHLPAPRGPDRPGGIEEEGGEQD
RDRSGPLVNGFLALIWVDLRSLFLFSYHRLRDLLLIVARIVELLG-------RRGWEVLK
YWWNLLQYWSQELKNSAISLLNATAVAVAEGTDRVIEALQRACRAILHIPRRIRQGLERL
LL- >ENV-B.syn4.2
MRVKGIRKNCQHLWRWGILL--------LGMLMICSAAEQLWVTVYYGVPVWRDANATLF
CASDAKAYDTEAHNVWATHACVPTDPNPQEVELKNVTENFNMWKNNMVEQMQEDIISLWD
QSLKPCVKLTPICVTLNCTDYVKNIT-NNATSTNSSW-GKPMEKGEIKNCSFNVTTSIRD
KVQKEYALFYRLDVVPI-DNDSNNNDSTNTNYTNYRLISCNTSTITQACPKVSFQPIPIH
YCAPAGFALLKCNDKKFNGTGPCKNVSTVQCTHGIKPVVSTQLLLNGSLAEEEIVIRSEN
FTNNAKTIIVQLNESVVINCTRPNNNTRKSIHIGPGRAFYATGDIIGDIRKAHCNISRAN
WNNTLRQIVEKLGEQFG-NKTIVFNQSSGGDVEIVMHSFNCGGEFFYCNSTQLFNSTWNF
--NGTWNKN---FNNTWNNTEGTNDTITLPCRIKQIINMWQGVGKAMYAPPISGQIRCSS
NITGLILTRDGGNN-NET--NRTETFRPGGGDMRDNWRSELYKYKVVKIEPLGIAPTKAR
RRVVQREKRAVGTIGAMFLGFLGTAGSTMGAASLTLTVQARLLLSGIVQQQNNLLKAIEA
QQHLLQLTVWGIKQLQARLLAVERYLGDQQLLGLWCSGKLICTTTVPWNASWSNKSLDK
IWDNMTWMEWEREIDNYTGLIYNLLEKSQNQQEKNELELLELDKWANLWNWFDITKWLWY
IKIFIMIIGGLIGLRIVFAVLSVVNRVRQGYSPLSLQTRLPTQRGPDRPEGIAEEGGERD
RDRSGPLVDGFLAIIWVDLRSLCLFSYHHLRDLLLIVTRIVELLG-------RRGWEALK
YWWNLLLYWSQELKNSAVNLLNTTAIAVAEGTDRIIEVLQRIYRAFLHIPRRIRQGFERA
LL- >ENV-B.syn4.3
MRVKEIRKNYQHLWKWGTML--------LGMLMICSAAGNLWVTVYYGVPVWKEANTTLF
CASDAKAYETEVHNVWATHACVPIDPNPQEVVLGNVTENFNMGKNNMVEQMHEDIISLWD
ESLKPCVKLTPLCVTLNCTDELKNATFRSNTTTNSSW--EKMEKGEIKNCSFNITTNMRD
KMQKEYALFYKLDVIPI-DSRNNSNNSTE--YNSYRLINCNTSVITQACPKISFEPIPIH
YCTPAGFAILKCKDKKFNGKGPCTNVSTVQCTHGIRPVVSTQLLLNGSLAEKEVVIRSDN
FTNNAKTIMVQLNVSVEINCTRPNNNTRRSIPIGPGRVFYTTEDIIGDIRQAHCNISRAQ
WNNTLKHIVEKLGKQFGNNKTIVFNHSSGGDPEIVMHSFNCRGEFFYCKSTKLFNSTWTR
```

Fig. 10 cont'd-2

```
N-NGTWTRN---DTERSNSTE---EHITLPCRIKQIINMWQEVGKAMYAPPIRGQIRCSS
NITGILLLTRDGGNDT-----SGTEIFRPGGGDMKDNWRSELYKYKVVRIEPLGVAPTEAK
RRVVQREKRAVG-IGAVFLGFLGAAGSTMGAAAVTLTVQARLLLSGIVQQQNNLLRAIEA
QQRLLQLTVWGIKQLQARVLAVERYLRDQQLLGIWGCSGKIICTTAVPWNTSWSNRSLNE
IWNNMTWMEWEKEIDNYTNLIYNLLEESQNQQEKNEQELLALDKWANLWNWFDISNWLWY
IKIFIIIVGGLVGLRIVFAVLSIVNRVRQGYSPLSFQTRLPAPRGPDRPEGIEEEGGERD
RDRSVRLVDGFLALIWDDLRSLCLFSYHRLRDLLLI----VELLG-------RRGWEILK
YWWNLLQYWGQELKNSAVSLLNATAIAVAEGTDRVIEVVQRAYRAILHIPTRIRQGLERA
LL-
>ENV-B.syn4.4
MRVKETRKNYQHLWRWGIML---------LGMLMICSATEKLWVTVYYGVPVWKEATTTLF
CASDAKAYDKEVHNVWATHACVPTDPSPQEVVLENVTENFNMWKNDMVEQMHEDIINLWD
QSLKPCVRLTPLCVTLNCTN-VNVTNLKNETNTKSSSGGEKMEEGEMKNCSFNITTSIRD
KVQKQYALFYKLDVVPI-DNDNTS---------YRLISCNTSVIKQACPKVSFEPIPIH
FCAPAGFAILKCNDKKFNGTGPCTNVSTVQCTHGIRPVISTQLLLNGSLAEEEVVIRSEN
FTDNAKTIIVQLNETVEINCTRPSNNTRKSIPIGPGRAFYTTGDIIGDIRQAYCNISRAK
WNNTLKQIVTKLREQFGNNKTIIFKQSSGGDPEIVTHSFNCGGEFFYCNSTKLFNSTWTW
N-NSTW--N---NTKRSNDTE---EIITLPCRIKQIINRWQEVGKAMYAPPIEGQIRCLS
NITGLLLLTRDGGTNNT----NTNETFRPGGGNMRDNWRSELYKYKVVQIEPLGVAPTKAK
RRVVQREKRAVG-IGALFLGFLGAAGSTMGAASITLTVQARQLLSGIVQQQRNLLRAIEA
QQHMLQLTVWGIKQLRARVLAVERYLKDQQLLGIWGCSGRLICTTNVPWNTSWSNKSLNE
IWDNMTWMQWEREIDNYTSLIYTLIEESQNQQEKNEQDLLALDKWASLWNWFSITNWLWY
IRIFIMIVGGLVGLRIVFTVISIVTRVRQGYSPLSFQTRLPTPRGPDRPEGTEEEGGERD
RDRSGRLVDGFLALFWDDLRSLCLFLYHRLRDLLLIAARIVELLG-------RRGWELLK
YWWNLLQYWIQELKNSAVSLFNAIAIAVAEGTDWVIEISQRAFRAVLHIPVRIRQGLERA
LQ-
>ENV-B.syn6.1
MRVTGIRKNYQHLWRWGTMLLWRWGTMLLGILMICSAAGKLWVTVYYGVPVWKDATTTLF
CASDAKAYDTEAHNVWATHACVPIDPNPQEVVLENVTENFNAWKNNMVEQMHEDMISLWD
QSLQPCVRLTPLCVTLNCTDDVRN-----ATSTNSSW-GKPMEKGEIKNCSFNITTSIRD
KVQKQYALFYKLDVVPI-DNDSNNTN--------YRLISCNTSIITQACPKITFEPIPIH
YCTPAGFALLKCNDKKFNGTGPCTKVSTVQCTHGIRPVVSTHLLLNGSLAEEEVIIRSEN
FTNNAKTIMVQLNVSVEINCTRPSNNTRKSIHIGPGRAFYTTGDIIGDIRKAHCNISRAN
WNNTLRQIVEKLGEQFGNNKTIVFNHSSGGDLEIVTHSFICGGEFFYCNSTKLFNSTWTW
N-NSTW--N---NTKRSNDTE---EIITLPCRIKQIINMWQEVGKAMYAPPIRGKIRCSS
NITGLLLTRDGGTNNT----NTNETFRPGGGMRDNWRNELYKYKVVRIEPLGIAPTEAK
RRVVQREKRAVG-IGAMFLGFLGTAGSTMGAASVALTVQARQLLPGIVQQQNNLLRAIDA
QQHLLQLTVWGIKQLQARILAVERYLKDQQLLGFWGCSGKLICTTNVPWNTSWSNKSYSQ
IWENMTWMEWEREINNYTGLIYNLLEKSQNQQEKNEQELLELDKWASLWSWFDISNWLWY
IKIFIIIVGGLVGLRIVFAVLSIINRVRQGYSPLSFQTHLPAPRGPDRPEGIAEEGGERD
RDRSGRLVNGFLALIWVDLRSLCLFSYHHLRDLLLI----VELLG-------RRGWEVLK
YWWNLLLYWSQELKNSAISLLNATAVAVAEGTDRVIEALQRACRAILHIPRRIRQGLERL
LL-
>ENV-B.syn6.2
MRVKETRKNYQHLWKWGTML---------LGILMICSATENLWVTVYYGVPVWKEATTTLF
CASDAKAYDKEVHNVWATHACVPTDPNPQEVELKNVTENFNMWKNNMVEQMQEDIISLWD
QSLKPCVRLTPLCVTLNCTD-LRNATNGNDTNTTSSS-REMMGGGEMKNCSFNITTNIRD
KVQKEYALFYKLDIVPI-DNDNTN---------YRLISCNTSVVTQACPKVSFEPIPIH
FCAPAGFAILKCNDKKFNGKGPCTNVSTVQCTHGIRPVISTQLLLNGSLAEEEVVIRSEN
```

Fig. 10 cont'd-3

FTNNVKTIIVQLNETVEINCTRPNNNTRRSIPIGPGRVFYTTEDIIGDIRQAHCNLSRTQ
WNNTLKQIVTKLREQFG-NKTIIFNQSSGGDPEIVMHTFNCGGEFFYCNTTKLFNSTW--
--NDTTINR----TEGSNNTR----NITLPCRIKQIINLWQEVGKAMYAPPIQGQISCSS
NITGLLLTRDGGNN-NET--NRTETFRPGGGNMRDNWRSELYKYKVVKIEPLGVAPTKAK
RRVVQREKRAVG-IGALFLGFLGAAGSTMGAASVTLTVQARQLLSGIVQQRNNLLRAIEA
QQRMLQLTVWGIKQLRARVLAVERYLKDQQLMGIWGCSGKLICTTTVPWNASWSNKSLNE
IWDNMTWMEWEREIDNYTSLIYTLIEESQNQQEKNELELLELDKWASLWNWFSITNWLWY
IRLFIMIVGGLVGLRIVFTVISIVTRVRQGYSPLSFQTRLPTPRGPDRPGGIEEEGGEQD
RDRSIRLVDGFLALIWDDLRSLCLFSYHRLRDLLWI----VELLG-------RRGWEALK
YLWNLLQYWSQELKKSAVSLFNATAIAVAEGTDWVIEVIQRAFRAFIHIPTRVRQGLERA
LQ-
>ENV-B.syn6.3
MRVKGIRKNCQHLWRWGILL--------LGMLMICSATEKLWVTVYYGVPVWKETTTTLF
CASDAKAYVAEKHNVWATHACVPTDPNPREVVMGNVTEEFNIWNNSMVEQMHEDIISLWE
QSLKPCVKLTPLCVSLKCTDL------KNDTNTNSSSGRMIMEKGEIKNCSFNITTGIRG
KVQ-EYSLFYKLDVVQM-DEDNTS----------YRLINCNTSVITQACPKVSFQPIPIH
YCAPAGFAILKCKDKKFNGTGSCKNVSTVQCTHGIRPVISTQLLLNGSLAEGEVVIRSEN
FTDNAKTIIVQLKDPVKINCTRPNNNTRKSIPIGPGRAFYATGDIIGDIRQAHCNISTTK
WNKTLGQVVKKLREQFK-NKTIVFKQSSGGDPEVVMHSFNCGGEFFYCNTSQLFNSTW--
--------N---STSLFNSTN---GTITLQCRIKQIINRWQEVGKAMYAPPIEGQIRCLS
NITGLLLVRDGGINVTNN--TGTEVFRPGGGDMRDNWRSELYKYKVIKIEPLGVAPTRAK
RRVVQREKRAVG-LGAMFLGFLGAAGSTMGAASITLTVQARQLLSGIVQQQRNLLRAIEA
QQHMLQLTVWGIKQLQARVLAVERYLQDQQLLGIWGCSGKLICTTTVPWNTSWSNKSLNQ
IWDNMTWMQWEKEIDNYTGLIYTLLEESQNQQEKNEHELLELDKWASLWNWFNITNWLWY
IKIFIMIIGGLIGLRIVFAVLSIVNRVRQGYSPISFQTRLPAPRGPDRPDGIEEEGGDRD
RDRSGRLVDGFLTLIWVDLRSLCLFSYRRLRDLLLIAARIVELLG-------HRGWEALK
YWWNLLQYWIQELKNSAVNLLNTTAIAVAEGTDRVIEVVQRAYRAILNIPTRIRQGFERA
LL-
>ENV-B.syn6.4
MRVKEIRKNCQRLWRWGTML--------LGMLMICSAAEQLWVTVYYGVPVWRDANATLF
CASDAKAYDTEVHNVWATHASVPTDPNPQEVVLGNVTENFNMWKNDMVEQMHEDVISLWD
QSLKPCVKLTPICVTLNCTDYVKNIT-NNATSTNSSW-GEPMEKGEIKNCSFNITTSMKD
KVQKTYALFYKLDVVPI-DNDSNNNDSTNTNYTNYRLISCNTSVIKQACPKVSFDPIPIH
YCTPAGFAILKCRDKKFNGTGPCKNVSTVQCTHGIRPVVPTQLLLNGSLAEEEIVIRSEN
FSDNAKTIIVHLNESVEINCTRLNNNTRKSIHMGPGRAFYATGEIIGDIRQAHCNISRAK
WNNTLKQIAIKLREQFGNNKTIIFKQSSGGDPEIVTHSFNCGGEFFYCNSTQLFNSTWNF
--NGTWNKN---FNNTWNNTEGTNDTITLPCRIKQIINMWQKVGKAMYAPPISGQIRCTS
NITGLLLTRDGGN---DT--SGTEIFRPGGGNMKDNWRSELYKYKVVQIEPLGVAPTEAK
RRVVQREKRAVG-IGAVFLGFLGAAGSTMGAAAVTLTVQARLLLSGIVQQQNNLLKAIEA
QQHLLRLTVWGIKQLQARLLAVERYLGDQQLLGLWGCSGKLICTTAVPWNTSWSNRSLNE
IWNNMTWMEWEKEIDNYTNLIYNLLEESQNQQEKNEKELLELDKWANLWNWFDISNWLWY
IRIFIMIVGGLIGLRIVFIVLSVVNRVRQGYSPLSLQTRLPTQRGPDRPEGTEEEGGERD
RDTSGRLVDGFLAIIWVDLRSLFLFSYHRLRDLLLIVTRIVELLG-------RRGWEILK
YWWNLLQYWGQELKNSAVSLLNATAITVAEGTDRVIEVLQRAGRAILHIPTRIRQGLERI
LL-
>ENV-B.syn6.5
MRVKGIRRNYQHLWRWGIML--------LGMLMICSATEQLWVTVYYGVPVWKEANTTLF
CASDAKAYKTEAHNVWATHASVPTDPNPQEIVLENVTENFNMWKNNMAEQMHEDIINLWD
QSLKPCVELTPLCVTLNCTDELKNATFRSNTTTNSSW--EKMEKGEIKNCSFNVTTSIRD
KMQKEYALFYRLDVVPI-DNDNTS----------YRLISCNTSVITQACPKISFEPIPIH
YCVPAGFAILKCNNKTFNGTGPCTNVSTVQCTHGIKPVVSTQLLLNGSLAEEDVVIRSEN
FTDNTKTIIVQLKEAVEINCTRPNNNTRKGIHIGPGRAFYTTGEIIGNIRQAHCNLSRAK
WNDTLKQIVIKLREQFG-NKTIVFNQSSGGDVEIVMHSFNCGGEFFYCNTTQLFNSTW--
--NANDIRN---VTRGSNRTTGGNDTLILPCRIKQIVNMWQEVGKAMYAPPIKGQIKCSS

Fig. 10 cont'd-4

```
NITGLLLTRDGGNNGNET--NGTEIFRPGGGDMRNNWRSELYKYKVVRIEPLGVAPTKAR
RRVVQREKRAVT-LGAMFLGFLGAAGSTMGAASMTLTVQARLLLSGIVQQQSNLLRAIEA
QQRLLQLTVWGIKQLQARILAIERYLKDQQLLGIWGCSGKIICTTAVPWNASWSNKSQDE
IWNNMTWMQWEREIDNYTGLIYNLIEESQNQQEKNEQELLALDKWANLWNWFDITKWLWY
IKIFIMIVGGLIGLRIVFTVLSIVNRVRKGYSPLSFQTRLPAQRGPDRPEGIEEEGGERD
RDRSGPLVDGFLAIFWVDLRSLFLFSYRHLRDLLLIVARIVELLG-------RRGWELLK
YWWNLLQYWSQELKSSAVSLLNATAIAVAEGTDRILEVLQRAYRAILHIPVRIRQGLERA
LL-
>ENV-B.syn6.6
MRVKGIRKNYQHLWRWGMML--------FGMLMICSAAGNLWVTVYYGVPVWREATTTLF
CASDAKAYETEVHNVWATHACVPTDPSPQEVVLENVTEDFNMWKNNMVDQMHEDIISLWD
ESLKPCVKLTPLCVTLNCTDDVRNVT-NNATNTNSSW-GEPMEKGEIKFCSFNITTSIRN
KVQKQYALFYKLDVIPI-DSRNNSNNSTE--YNSYRLINCNSSTITQACPKVTFEPIPIH
YCAPAGFAILKCNNKKFNGTGPCNNVSTVQCTHGIRPVVSTQLLLNGSLAEKEVVIRSDN
FTNNAKTIIVQLNESVVINCTRPNNNTRKRISMGPGRVYYTTGEIIGDIRRAHCNISRAQ
WNNTLKHIVEKLGKQFGNNKTI-FNHSSGGDPEIVMHSFNCRGEFFYCKSTKLFNSTWTR
N-NGTWTRN---DTERSNSTE---EHITLPCRIKQIINMWQGVGKAMYAPPIRGQIRCSS
NITGLILTRDGGNNDT----RGTEIFRPGGGDMKDNWRSELYRYKVVKIEPLGIAPTKAK
RRVVQREKRAVGTIGAMFLGFLGTAGSTMGAASLTLTVQARLLLSGIVQQQNNLLRAIEA
QQHLLQLTVWGIKQLQAKVLAVERYLRDQQLLGIWGCSGRLICTTNVPWNASWSNKSLDK
IWNNMTWMEWDREINNYTSLIYSLIEESQNQQEKNEQDLLALDKWASLWNWFDITNWLWY
IKIFIMVVGGLVGLRIIFAVLSIVNKVRQGYSPLSLQTHLPARRGPDRPEGIEGEGGERD
RDRSVRLVDGFLALFWDDLRSLCLFLYHRLRDLLLIVTRTVELLG-------RRGWEALK
YCWNLLQYWSQELKNSAVSLFNAIAIAVAEGTDRIIEVVQRICRAIRHIPRRIRQGFERA
LL- >ENV-C.syn1.1
MRVRGIQRNWPQWWIWGILG--------FWMLMICNVVGNLWVTVYYGVPVWKEAKTTLF
CASDAKAYEKEVHNVWATHACVPTDPNPQEIVLENVTENFNMWKNDMVDQMHEDIISLWD
QSLKPCVKLTPLCVTLNCTDVKVNATSNGTTTYNNSI-DS--MNGEIKNCSFNTTTEIRD
KKQKVYALFYRLDIVPL-DNNSSE---------YRLINCNTSTITQACPKVSFDPIPIH
YCAPAGYAILKCNNKTFNGTGPCNNVSTVQCTHGIKPVVSTQLLLNGSLAEEEIIIRSEN
LTNNAKTIIVHLNESVEIVCTRPNNNTRKSIRIGPGQTFYATGDIIGDIRQAHCNISEKQ
WDQTLYRVSEKLKEHFP-NKTIKFAPSSGGDLEITTHSFNCRGEFFYCNTSKLFNSTY--
---NSTQMHN---DTGS--NST-----ITLPCRIKQIINMWQEVGRAMYAPPIAGNITCKS
NITGLLLTRDGGTNN-----NNTETFRPGGGDMRDNWRSELYKYKVVEIKPLGIAPTKAK
RRVVEREKRAVG-IGAVFLGFLGAAGSTMGAASITLTVQARQLLSGIVQQQSNLLRAIEA
QQHMLQLTVWGIKQLQTRVLAIERYLKDQQLLGIWGCSGKLICTTAVPWNSSWSNKSQTD
IWDNMTWMQWDREISNYTDTIYRLLEDSQNQQEKNEKDLLALDSWKNLWNWFDITNWLWY
IKIFIMIVGGLIGLRIIFAVLSIVNRVRQGYSPLSFQTLTPNPRGPDRLGRIEEEGGEQD
RDRSIRLVSGFLALAWDDLRSLCLFSYHRLRDFILVTARAVELLGRSSLRGLQRGWEALK
YLGSLVQYWGLELKKSAISLLDTIAIAVAEGTDRIIELIQRICRAIRNIPRRIRQGFEAA
LL- >ENV-C.syn3.1
MRVMGIQRNCQQWWIWGSLG--------FWMLMIYNVMGNLWVTVYYGVPVWKEAKTTLF
CASDAKAYDTEVHNVWATYACVPTDPNPQEMVLENVTENFNMWKNNMVDQMHEDIISLWD
QSLKPCVKMTPLCVTLNCSNAKKD--------NTTI-DNE-MKGEIKNCSFNITTELRD
KKKQVYALFYKLDIVPL-NSNSSE---------YRLINCNTSAITQACPKVSFDPIPIH
YCAPAGYAILKCNNETFNGTGPCNNVSTVQCTHGIRPVVSTQLLLNGSLAEKEIIIRSEN
LTDNVKTIIVHLNESVEINCTRPNNNTRRSIRIGPGQAFYATGEIIGDIRQAYCNISGEK
WNETLQRVGKKLKEHFP-NKTIKFAPSSGGDLEITTHSFNCRREFFYCNTSGLFNGTY--
---NGNGTYN---GTGTDTNST-----ITIPCRIKQIINMWQEVGRAMYAPPIEGNITCKS
NITGLLLVRDGGTENNTET-NNTETFRPGGGDMRDNWRSELYRYRVVEIKPLGIAPTKAK
RRVVERGKRAVG-IGAVFLGFLGVAGSTMGAASITLTVQARQVLSGIVQQQSNLLRAIEA
QQHLLQLTVWGIKQLQTRVLAIERYLKDQQLLGIWGYSGKLICTTAVPWNSSWSNRSQED
```

Fig. 10 cont'd-5

```
IWNNMTWMQWDREINNYTNTIYRLLEDSQNQQEKNEQDLLALDSWKNLWNWFDITNWLWY
IRIFIMIVGGLIGLRIIFAVLSIVNRVRQGYSPLSLQTLTPNPRELDRLGRIEEGGGEQD
RDRSIRLVSGFLALAWDDLRSLCLFSYHRLRDFILIAARAAELLGRSSLKGLQRGWEILK
YLGSLIQYWGLELKKSAINLLDTIAIVVAEGTDRIIELIQRICRAICNIPRRIRQGFEAA
LQ-
>ENV-C.syn3.2
MRVRGILRNWQQWWIWGILG--------FWMLMICNVVGNLWVTVYYGVPVWREAKTTLF
CASDAKAYEREVHNVWATHACVPTDPNPQELVLENVTENFNMWKNDMVDQMHQDIISLWD
ESLKPCVKLTPLCVTLKCVNVTKNS--NATVNSNATV-NNNTMGEEIKNCSFNATTEIRD
KKQNVYALFYRLDIVPL-NENNDNSS--------YRLINCNTSTITQACPKVTFDPIPIH
YCTPAGYAILKCNDKTFNGTGPCHNVSTVQCTHGIKPVISTQLLLNGSLAEEEIIIRSEN
LTNNVKTIIVHLNKSVEIVCTRPGNNTRKSVRIGPGQTFYATGDIIGDIRQAHCNISRTA
WNKTLQEVGKKLAEHFP-NKTIEFKPSSGGDLEVTTHSFNCRGEFFYCNTSKLFNSTYNS
TYNSTYNSN---STNSNSNST-----ITLQCRIKQIINMWQKVGRAIYAPPIAGNITCRS
NITGLLLTRDGGNNNDTGNNNDTEIFRPGGGDMKDNWRNELYKYKVVEVKPLGIAPTGAK
RRVVEREKRAVG-LGAVFLGFLGAAGSTMGAASMTLTVQARQLLSGIVQQQNNLLRAIEA
QQHMWQVTVWGIKQLQARVLALERYLKDQQLLGLWGCSGKLICTTNVPWNSSWSNKSLTD
IWENMTWMQWDKEISNYTDTIYRLLEVSQNQQEKNEKDLLALDSWNNLWNWFSITKWLWY
IKIFIMIVGGLIGLRIIFGVLSIVKRVRQGYSPLSFQTLTPNPRGPDRLGRIEEEGGEQD
KDRSIRLVNGFLALAWDDLRNLCLFSYHQLRDFILIVARAVELLGHSSLRGLQRGWEALK
YLGSLVQYWGLELKRSAISLLDTTAIAVAEGTDRIIEVIQRICRAIRNIPTRIRQGFEAA
LLQ
>ENV-C.syn3.3
MRVRGIQRNWPQWWIWGILG--------FWMIIICRVVGNLWVTVYYGVPVWTEAKATLF
CASDAKAYEKEVHNVWATHSCVPTDPNPQEIVLGNVTENFNMWENDMVDQMHEDVISLWD
QSLKPCVKLTPLCVTLNCT--------NANVTVNATSDGS--IKEEIKNCSFNTTTEIRD
KKQKVYALFYRPDIVPLSGSNSSE---------YILINCNTSTVTQACPKVSFEPIPIH
YCAPASYAILKCNNKTFNGTGPCQNVSTVQCTHGIKPVVSTQLLLNGSLAEGEIIIRSEN
LTNNAKTIIVHLNESIEIVCTRPNNNTRKSIRIGPGQTFFATGDIIGNIRQAHCNISEEK
WNKTLQEVSRKLREHFP-NKTIIFNSSSGGDLEITTHSFNCGGEFFYCNTTKLFNDS---
--------------ALSAFNKTS--NETITLPCRIKQIINMWQGVGRAMYAPPIAGNITCNS
SITGLLLTRDGGT-------NNTEIFRPGGGNMKDNWRSELYKYKVVEIKPLGVAPTEAK
RRVVEREKRAVG-IGAVLLGFLGAAGSTMGAASITLTAQARQLLSGIVQQQSNLLKAIEA
QQHMLQLTVWGIKQLQARVLAIERYLQDQQLLGIWGCSGKLICTTTVPWNSSWSNKSQTD
IWDNMTWMQWDREISNYTNTIYRLLEESQNQQEQNEKDLLALDKWQNLWSWFSITNWLWY
IKIFIIIVGGLIGLRIILGVLSIVRRVRQGYSPLSFQTLIPNPRGPDRLGGIEEEGGEQD
RDRSVRLVSGFLSLAWDDLRSLCLFCYHRLRDFILVTARAVELLGRSSLRGLQKGWEALK
YLGNLVQYWGLELKKSAISLLDTIAIAVAEGTDRIIEFIQRICRAIRNIPRRIRQGLEAA
LQ-
>ENV-C.syn4.1
MRVRGILRNYQQWWIWGSLG--------FWMLMIYNVGGNLWVTVYYGVPVWKEAKTTLF
CASDAKAYDTEVHNVWATHACVPTDPDPQEIVLENVTENFNMWENDMVDQMHEDIISLWD
ESLKPCVKLTPLCVTLKCTNVTST---GNTTRGNNTS-EN---REEMKNCSFNTTTEIRD
KKQKVYALFYKPDVVPL-KENSSE---------YILINCNTSTVTQACPKVSFDPIPIH
YCAPAGFAILKCNNKTFNGTGPCNNVSTVQCTHGIKPVVSTQLLLNGSLAEEEIIIRSEN
LTDNAKTIIVHLNESIEIVCTRPGNNTRKSIRIGPGQAFYATGDIIGDIRQAYCNISKAT
WNKTLQEVGKELAKHFP-NKTINFNSSSGGDLEITTHSFNCGGEFFYCNTTKLFNNSL--
--------------LNNTADNST---STITLQCRIKQIINMWQGVGQAMYAPPIAGNITCKS
NITGLLLLRDGGDTST----NGTEIFRPGGGNMKDNWRSELYKYKVVEVKPLGIAPTGAK
RRVVEREKRAVG-IGAVLLGFLGAAGSTMGAASITLTAQARQVLSGTVQQQSNLLRAVEA
QQHMLQLTVWGIKQLQTRVLAIERYLKDQQLLGIWGCSGKLICTTNVPWNSSWSNKSQEE
IWENMTWMQWDREISNYTGTIYRLLEESQNQQEKNEQDLLALDSWKNLWNWFDISNWLWY
IKIFIIIVGGLIGLRIIFGVLSIVKRVRQGYSPLSFQTLIPNPRGPDRLERIEEGGEQD
RGRSIRLVSGFLAIAWDDLRSLCLFSYHQLRDFILIAVRAVELLGHSSLRGLQRGWEALK
YLGSLVQYWGLELKRSAISLLDTIAIVVAEGTDRIIEFIQRICRAIRNIPTRIRQGFEAA
LQ-
```

Fig. 10 cont'd-6

>ENV-C.syn4.2
MRVMGIQRNCQQWWIWGILG--------FWILMICNVMGNLWVTVYYGVPVWKEAKATLF
CASDAKAYEKEVHNIWATHACVPTDPNPQELVLENVTENFNMWDNDMVDQMHQDIISLWD
QSLKPCVKLAPLCVTLNCTNATVTATRNGSDIMNTTS-ND----GEMKNCSFNVTTELRD
KKKKEYALFYRLDIVPL-NEGSGNANQNNSNYSDYRLINCNTSAITQACPKVTFDPIPIH
YCTPAGYAILKCNDKTFNGTGPCHNVSTVQCTHGIRPVVSTQLLLNGSLAEGEIMIRSEN
LTNNAKTIIVHLNKSVEIVCTRPNNNTRKSVRIGPGQTFYATNDIIGDIRQAHCNISEEK
WNKTLQQVGKKLAEHFP-NKTIEFKPSSGGDLEVTTHSFNCRGEFFYCNTSGLFNGTF--
--DGT-------ESNSTSNAT-----ITIPCRIKQIINMWQKVGRAIYAPPIAGNITCRS
NITGLLLVRDGGNDNKT---NDTETFRPGGGDMRDNWRSELYKYKVVEVKPLGVAPTKAK
RRVVQREKRAVG-IGAVFLGFLGVAGSTMGAASMTLTVQARQVLSGIVQQQSNLLRAIEA
QQHLLQLTVWGIKQLQARVLALERYLRDQQLLGMWGCSGKLICTTAVPWNSSWSNKSQED
IWGNMTWMQWDKEISNYTNTIYRLLEDSQNQQERNEKDLLALDSWKNLWSWFDITNWLWY
IKIFIMIIGGLIGLRIIFAVLSIVNRVRQGYSPLSLQTLTPNPRGPDRLGRIEEEGGEQD
KDRSIRLVNGFLALAWDDLRNLCLFSYHRLRDFILIVARAVELLGRNSLRGLQRGWETLK
YLGSLIQYWGLELKKSAISLLDTTAIAVAEGTDRIIELIQRICRAICNIPRRIRQGLEAA
LQ-
>ENV-C.syn4.3
MRVRGIQRNWPQWWIWGILG--------FWMIIICRVVGNLWVTVYYGVPVWREAKTTLF
CASNAKAYEKEVHNVWATHACVPTDPNPQEIVLGNVTENFNMWKNDMVDQMHEDVISLWD
QSLKPCVKMTPLCVTLNCTDVKVNATSNGTTTYNNSI-DS--MNGEIKNCSFNTTTELRD
KKQKAYALFYRPDIVPLPGKDNSKDNSSEYEE--YILINCNSSTITQACPKVSFEPIPIH
YCAPASYAILKCNNETFNGTGPCKNVSTVQCTHGIKPVISTQLLLNGSLAEKEIIIRSEN
LTNNVKTIIVHLKESVEINCTRPNNNTRKSIRIGPGQTFYATGDIIGNIRQAHCNISREK
WNTTLKRVKEKLKEHFP-NKTIKFAPSSGGDLEITTHTFNCRGEFFYCNTSKLFNSTYV-
--NRTDMND---D--TGNNST-----ITLPCRIKQIINMWQEVGRAMYAPPIAGNITCNS
SITGLLLTRDGGNNT-----ENTETFRPGGGNMKDNWRNELYKYKVVEIKPLGVAPTEAK
RRVVEREKRAVG-LGAVFLGFLGAAGSTMGAASITLTVQARQLLSGIVQQQNNLLRAIEA
QQHMLQLAVWGIKQLQARVLAIERYLQDQQLLGIWGCSGKLICTTSVPWNSSWSNRSQED
IWNNMTWMQWDREISNYTDTIYRLLEVSQNQQEQNEKDLLALDKWQNLWSWFSITNWLWY
IRIFIMIVGGLIGLRIVFAVLSLVNRVRQGYSPLSFQTLTPSPRGPDRLGGIEEEGGEQD
RDRSIRLVSGFLSLAWDDLRSLCLFSYHRLRDFILIAARAAELLGRSSLRGLQRGWEILK
YLGSLAQYWGLELKKSAINLLDTIAIAVAEGTDRIIEVIQRICRAIYNIPRRIRQGFEAS
LL-
>ENV-C.syn4.4
MRVRGIPRNWQQWWIWGILG--------FWMLMICNVVGNLWVTVYYGVPVWTEAKTTLF
CASDAKAYEREVHNVWATYACVPTDPNPQEMVLENVTENFNMWKNDMVEQMHEDIISLWD
QGLKPCVKLTPLCVTLNCSNAKKD---------NTTI-DNE-MKGEIKNCSFNITTELRD
KKQQVYALFYKLDIVPL-NSNSSE----------YRLINCNTSTITQACPKVNFDPIPIH
YCAPAGYAILKCNNKTFNGTGPCQNVSTVQCTHRIKPVVSTQLLINGSLAEGEIIIRSEN
LTDNVKTIIVHLNESVEIVCTRPNNNTRKSMRIGPGQTFYATGEIIGDIRQAHCNISKEK
WNNTLQEVREKLREHFP-NKTIKFAPHSGGDPEITTHSFNCRGEFFYCNTSQLFNSTY--
--NSTQMHN---DTGS--NST-----ITLPCKIKQIINMWQGVGRAMYAPPIEGNITCTS
NITGLLLTRDGGT-------NNTEIFRPGGGDMRNNWRSELYKYKVVEIKPLGIAPTKAK
RRVVERGKRAVG-IGAVLFGFLGAAGSTMGAASIALTAQARQLLSGIVQQQSNLLKAIEA
QQHMWQVTVWGIKQLQARVLAMERYLKDQQLLGLWGCSGKLICTTTVPWNSSWSNKSQTD
IWDNMTWMQWDREINNYTNTIYKLLEDSQNQQEKNEKDLLALDSWNNLWNWFSITKWLWY
IKIFIMIVGGLIGLRIILGVLSIVRRVRQGYSPLSFQTLTPNPRELDRLGRIEEGGGEQD
RDRSVRLVSGFLALAWDDLRSLCLFCYHRLRDFILVTARAVELLGRSSLKGLQRGWEALK
YLGNLVQYWGLELKKSAISLFDTIAITVAEGTDRIIELVQRICRAIRNIPRRIRQGFEAA
LL-
>ENV-C.syn6.1
MRVRGIQRNWPQWWIWGILG--------FWIIIMCRVMGNMWVTVYYGVPVWREAKTTLF
CASDAKGYEKEVHNAWATHACVPTGPNPQEMVLENVTENFNMWKNNMVDQMHEDIINLWD
QSLKPCVRLTPLCVTLKCVNVTKNS--NATVNSNATV-NNNTMGEEIKNCSFNATTEIRD
KKQKAYALFYRPDIVPL-NENSSSENNSSE----YILINCNTSTITQACPKVSFDPIPIH
YCAPASYAILKCNNETFNGTGPCQNVSTVQCTHGIKPVISTQLLLNGSLAEEDIIIRSEN

Fig. 10 cont'd-7

LTNNAKTIIVHLNQSVEIVCTRPGNNTRKSMRIGPGQTFYATNDIIGNIRQAHCNISEGK
WNETLLRVKKKLEEHFP-NKTIKFEPSSGGDLEITTHTFNCRGEFFYCDTSTLFNHTY--
--VSAYMNNTDVSADRKNDTQ-SNSTITLPCRIRQIINMWQEVGRAIYAPPIAGNITCRS
NITGLLLVRDGGNTT-----NSTETFRPEGGNMKDNWRSELYKYKVVEIRPLGIAPTGAK
RRVVEREKRAVG-IGAVFLGFLGVAGSTMGAASMTLTVQARQVLSGVVQQQSNLLQAIEA
QQHLLQLTVWGIKQLQTRVLALERYLRDQQLLGIWGCSGKIICTTAVPWNTSWSNKSQED
IWNNMTWMQWDREINNYTNTIYKLLEESQNQQEKNEQDLLALDSWNSLWNWFSITKWLWY
IRIFIIIVGSLIGLRIIFGVLSIVKRVRQGYSPLLSQTLTPNPREPDRLGRIEEGGGEQD
RDRSVRLVNGFLALVWDDLRSLCLFCYHRLRDFILVTARVVELLGRSSLRGLQKGWEALK
YLGSLVQYWGLELKKSAINLLDTIAIAVGEGTDRIIEVIQRICRAIYNIPRRIRQGFEAS
LL-
>ENV-C.syn6.2
MRVRGILRNYQQWWIWGSLG--------FWMLMIYNVGGNLWVTVYYGVPVWTDAKTTLF
CASDAKAYDKEVHNVWATHACVPTDPNPQELVLENVTENFNMWKNDMVNQMHEDIISLWD
ESLKPCVKLTPLCVTLNCTNATVTATRNGSDIMNTTS-ND----GEMKNCSFNITTELRD
KKRKEYALFYRLDIVPL-DENNSSEKSSENSSEYYRLINCNTSAITQACPKVTFDPIPLH
YCAPAGYAILKCKDKTFNGTGPCSNVSTVQCTHGIKPVVSTRLLLNGSLAEGEIIIRSEN
LTNNVKTIIVHLKEPVEINCTRPNNNTRESIRIGPGQTFYATGDIIGDIRQAHCNISREK
WNKTLQEVGKKLAEHFP-NKTIKFAPHSGGDLEITMHSFNCRGEFFYCNTSGLFNGTY--
--MPTYMPN---GTESNSNST-----ITIPCRIKQIINMWQEVGRAMYAPPIEGNITCNS
NITGLLLVRDGGINKT----NNTETFRPGGGDMRNNWRSELYKYKVVEIKPLGVAPTEAK
RRVVEREKRA-A-LGAMFLGFLGAAGSNMGAASITLTAQARQLLSGIVQQRSNLLRAIEA
QQHLLQLTVWGVKQLQARVLAMERYLKDQQLLGLWGCSGKLICTTSVPWNSSWSNRSQEE
IWNNMTWMEWDREISNYTNTIYRLLEDSQNQQEKNEKDLLALDSWKNLWSWFDITNWLWY
IKIFIMIIGGLIGLRIVFAVLSIVNRVRQGYSPLSFQTLTPSPRGPDRLGRIEEEGGEQD
KDRSVRLVSGFLSLAWDDLRSLCLFSYHRLRDLILIAARAVELLGHSSLRGLQRGWEILK
YLGSLAQYWGLELKRSAISLLDTIAITVAEGTDRIIEIIQRICRAICNIPRRIRQGFETA
LL-
>ENV-C.syn6.3
MRVMGILRNCQQWWIWGVLG--------FWMLMICNVVGNLWVTVYYGVPVWKEAKTTLF
CASNAKAYEREVHNIWATHACVPTDPNPQEMVLKNVTENFNMWKNDMVDQMHEDVISLWD
QSLKPCVKLAPLCVTLNCTNVTVNDTLHQNFT-------------DMKNCSFNVTTELRD
KKQKVYALFYRLDVVPL-GDNNSS----------YRLINCNTSTIAQACPKVNFDPIPIH
YCTPAGYAILKCNDKTFNGTGPCKNVSTVQCTHEIKPVVSTQLLLNGSLAEEGIIIRSEN
LTDNAKTIIVHLNESVEINCTRPGNNTRQSIRIGPGQAFYATGAIIGDIRQAHCNISKDE
WEKTLKRVSEKLKEHFP-NKTIEFKPSSGGDLEVTTHSFNCRREFFYCNTSKLFNSTY--
--NSTQMHN---DTGS--NST-----ITLPCKIKQIINMWQGVGQAMYAPPIKGNITCKS
NITGILLTRDGGNLT-----NGTETFRPGGGDMKDNWRSELYRYRVVEIKPLGIAPTKAK
RRVVQREKRAVG-IGALFLGFLGTAGSTMGAASLTLTVQARQLLSSIVQQQSNLLRAIEA
QQHMLQLTIWGIKQLQTRVLAVERYLKDQQLLGMWGCSGKLICTTAVPWNASWSNKSQEE
IWGNMTWMQWDREISNYTDIIYRLLEESQNQQERNEKDLLALDSWNNLWNWFNITNWLWY
IKIFIMIVGGVIGLRIIFAVLSLVNRVRQGYSPLSFQTLTPNPRELDRLGRIEEEGGEQG
RDRSIRLVNGFLAIAWDDLRSLCLFSYRRLRDFILIAARAAELLGRSSLRGLQRGWETLK
YLGSLIQYWGLELKKSAISLFDTIAIAVAEGTDRIIELIQRICRAIRNIPRRIRQGLEAA
LQ-
>ENV-C.syn6.4
MRVMGIQRNCQQWWIWGILG--------FWMLMIYNVVGNLWVTIYYGVPVWKEAKATLF
CASDAKAYDTEVHNVWATHACVPTDPDPQEMVLGNVTENFNMWKNDMADQMHEDIISLWD
QGLKPCVKLTPLCVTLHCTN-------TNITNENRTI-GDKLNE-EMKNCSFNTTTELRD
KKQQVYALFYKPDVVPL-NGGEHNETGE------YILINCNSSTITQACPKVSFEPIPIH
YCAPAGFAILKCNNKTFNGTGPCHNVSTVQCTHGIRPVVSTQLLLNGSLAEEEIIIRSEN
LTDNVKTIIVHLNKSVEIVCTRPNNNTRKSIRIGPGQTFFATNDIIGDIRQAYCNISAEK
WNKTLERVEEKLKEHFP-NKTIKFNSSSGGDLEITTHSFNCRGEFFYCNTSNLFNGTY--
--HGTQSTN---ST----NST-----ITLQCRIKQIINMWQKVGRAMYAPPIAGNITCKS
NITGLLLLRDGGTEN-----NDTETFRPGGGNMRDNWRSELYKYKVVEVKPLGIAPTTAK
RRVVERDKRAVG-IGAVLLGFLGAAGSTMGAASMALTVQARQLLSGIVQQQSNLLRAVEA

Fig. 10 cont'd-8

```
QQHMLQLTVWGIKQLQARVLALERYLKDQQLLGIWGCSGRLICTTAVPWNSSWSNKTQGE
IWENMTWMQWDKEINNYTNTIYRLLEESQTQQEQNEKDLLALDSWKNLWNWFDITKWLWY
IKIFIMVVGGLIGLRIIFAVLSIVNSVRQGYSPLSLQTLTPNPRGPDRLERIEEEGGEQD
RNRSIRLVNGFLALAWDDLRSLCLFSYHHLRDFILVTARAVELLGRSSLKGLQRGWEALK
YLGNLVQYWGLELKKSAISLLDTTAIAVAEGTDRIIELVQRICRAILNIPTRIRQGFEAA
LQ-
>ENV-C.syn6.5
MRVRGIPRNWPQWWTWGILG--------FWMIIICRVVGNLWVTVYYGVPVWTEAKTTLF
CASDAKAYEREVHNVWATHSCVPTDPNPQEIVLGNVTENFNMWENDMVDQMHQDIISLWD
QSLKPCVKMTPLCVTLNCSNAKKD---------NTTI-DNE-MKGEIKNCSFNITTEIRD
KKQKVHALFYRLDIVPL-NEGSGNANQNNSNYSDYRLINCNTSTVTQACPKVTFDPIPIH
YCAPARYAILKCNNNTFNGTGPCNNVSTVQCTHGIKPVVSTQLLLSGSLAEEEIVIRSEN
LTNNAKIIIVHLNESVEIVCTRPNNNTRRSIRIGPGQTFYATGEIIGDIRQAHCNISAKQ
WNTTLERVKEKLREHFP-NKTIKFEPHSGGDPEITTHSFNCGGEFFYCNTSQLFNSTY--
---NSTYMSN---NTGENSNET-----ITLPCRIKQIINMWQQVGRAMYAPPIAGNITCNS
SITGLLLTRDGGNNNDTGNNNDTEIFRPGGGDMRDNWRSELYKYKVVELKPLGIAPTEAK
RRVVKREKRAVG-IGAVLFGFLGAAGSTMGAASIALTAQARQVLSGIVQQQNNLLRAIEA
QQHVLQLTVWGIKQLQTRVLAIERYLKDQQLLSLWGCSGKLICTTTVPWNSSWSNKSLTD
IWDNMTWMQWDREISNYTGTIYRLLEDSQSQQEKNEKDLLELDKWNNLWNWFDISNWLWY
IKIFIIIVGGLIGLRIIFAVLSIINRVRQGYSPLLFQTLTPNPRGLDRLGRIEEEGGEQD
KDRSIRLVNGFLALAWEDLRSLCLFSYHQLRDFILIVARAVELLG-------RRGWEALK
YLGNLVLYWGLELKKSAVSLLDTIAIAVAGGTDRIIEVVQRICRAIRNIPTRIRQGLEAA
LL-
>ENV-C.syn6.6
MRVRGILRNWQQWWIWGILG--------FWMVMICNVMGNLWVTVYYGVPVWQEAKTTLF
CASDAKAYEKEVHNVWATHACVPTDPSPQEIVLENVTENFNMWKNDMVEQMHEDIISIWD
QSLKPCVTLTPLCVTLNCTDVKVNATSNGTTTYNNSI-DS--MNGEIKNCSFNTTTEIRD
KKKQVYALFYKLDIVPL-NSNSSE----------YRLINCNTSAVTQACPKVSWDPIPIH
YCAPAGYAILKCNNKTFNGTGPCTNVSTVQCTHRIKPVVTTQLLLNGSLAEKEIIIRSEN
LTNNIKTIIVHLNESIEIVCTRPNNNTRKSVRIGPGQTFFATGDIIGDIRKAHCNISEDK
WNETLQRVGKKLVEHFP-NKTIKFAPSSGGDLEVTTHSFNCKGEFFYCNTTKLFD-----
-------------DSERINTTT---TTIILPCRIKQFINMWQGVGRAMYAPPIAGNITCTS
NITGLLLTRDGGT-------NNTEIFRPGGGNMKDNWRNELYKYKVVEVKPLGVAPTKAK
RRVVEREKRAVG-LGAVFLGFLGAAGSTMGAASITLTVQARQLLFGIVQQQSNLLKAIEA
QQHMWQVTVWGIKQLQARVLAIERYLQDQQLLGIWGCSGKLICTTNVPWNSSWSNKSQTD
IWDNMTWMQWDKEISNYTDTIYRLLEVSQNQQEENEKDLLALDKWQNLWNWFSITNWLWY
IRIFIMIVGGLIGLRIILGVLSIVRRVRQGYSPLSFQTLIPNPRGPDRLGGIEEEGGEQD
RDRSIRLVSGFLALAWDDLRNLCLFSYHRLRDFILIVVRAVELLGRNSLRGLQRGWEALK
YLGSLGQYWGLEIKKSAISLLDTIAIVVAEGTDRIIEFIQRFCRAIRNLPRRIRQGFEAA
LL-
>ENV-M.syn1.1
MRVTGIRKNYQHLWRWGTMLLWRWGTMLLGMLMICSAAGNLWVTVYYGVPVWKEATTTLF
CASDAKAYDTEVHNVWATHACVPTDPNPQEVVLENVTENFNMWKNNMVEQMHEDIISLWD
QSLKPCVKLTPLCVTLNCTDDVRNVT-NNATNTNSSW-GEPMEKGEIKNCSFNITTSIRD
KVQKEYALFYKLDVVPI-DNDSNNTN--------YRLISCNTSVITQACPKVSFEPIPIH
YCAPAGFAILKCNDKKFNGTGPCTNVSTVQCTHGIKPVVSTQLLLNGSLAEEEVVIRSEN
FTNNAKTIIVQLNESVEINCTRPNNNTRKSIRIGPGQTFYATGDIIGDIRQAHCNISRAQ
WNNTLKHIVEKLGKQFGNNKTIVFNHSSGGDPEIVMHSFNCGGEFFYCNTTKLFNSTWTR
N-NGTWTRN---DTERSNSTE----EHITLPCRIKQIINMWQEVGKAMYAPPIRGQIRCSS
NITGLLLTRDGGNDT-----SGTEIFRPGGGDMRDNWRSELYKYKVVKIEPLGVAPTKAK
RRVVQREKRAVG-IGAVLFGFLGAAGSTMGAASITLTVQARQLLSGIVQQQNNLLRAIEA
QQHLLQLTVWGIKQLQARVLAVERYLKDQQLLGIWGCSGKLICTTAVPWNSSWSNKSLNE
IWNNMTWMEWEREIDNYTGLIYTLIEESQNQQEKNEQELLELDKWASLWNWFDISNWLWY
IKIFIMIVGGLIGLRIVFAVLSIVNRVRQGYSPLSFQTRLPAPRGPDRPEGIEEEGGERD
RDRSIRLVSGFLALAWDDLRSLCLFSYHRLRDLLLIVTRIVELLG-------RRGWEALK
```

Fig. 10 cont'd-9

```
YWWNLLQYWSQELKNSAVSLLNATAIAVAEGTDRVIEALQRACRAILHIPRRIRQGLERA
LL-

>ENV-M.syn3.1
MRVRGIQRNWPQWWIWGILG--------FWMLMICNVVGNLWVTVYYGVPVWKEAKTTLF
CASDAKAYEKEVHNVWATYACVPTDPNPQEIHLENVTEEFNMWKNDMVDQMHEDIISLWD
QSLKPCVQLTPLCVTLNCTN-VNVTNLKNETNTKSSSGGEKMEEGEMKNCSFNITTSIRD
KVQKEYALFYKLDVVPI-DNDSNNTN--------YRLISCNTSVITQACPKVTFEPIPIH
YCTPAGFAILKCKDKKFNGTGPCKNVSTVQCTHGIKPVISTQLLLNGSLAEEEIIIRSEN
ITNNAKTIIVQLNESVEINCTRPGNNTRKSVRIGPGQTFYATGEIIGDIRQAHCNLSRAK
WNDTLKQIVIKLREQFG-NKTIVFNQSSGGDPEIVMHSFNCGGEFFYCNTTQLFNSTW--
----------N---STSLFNSTN---GTITLQCRIKQIINMWQEVGKAMYAPPIEGNITCKS
NITGLLLVRDGGT---EP--NDTETFRPGGGNMKDNWRSELYKYKVVVKIEPLGVAPTKAK
RRVVQREKRAVGTIGAMFLGFLGAAGSTMGAASMTLTVQARLLLSGIVQQQNNLLRAIEA
QQHLLQLTVWGIKQLQARILAVERYLKDQQLLGLWGCSGKLICTTAVPWNTSWSNKSQTD
IWDNMTWMEWEREIDNYTGLIYTLIEESQNQQEKNEQELLELDKWASLWNWFDITKWLWY
IKIFIMIVGGLVGLRIVFAVLSIVNRVRKGYSPLSFQTLTPNPRGPDRLGRIEEEGGEQD
RDRSIRLVSGFLALAWDDLRSLCLFSYHQLRDFILIVARAVELLGRSSLRGLQRGWEALK
YLGSLVQYWGLELKKSAISLLDTIAIAVAEGTDRIIEVIQRICRAIRNIPRRIRQGFERA
LL- >ENV-M.syn3.2
MRVTGIRKNYQHLWRWGTMLLWRWGTMLLGILMICSAAGKLWVTVYYGVPVWRDAETTLF
CASDAKAHETEVHNIWATHACVPTDPNPQEVVLGNVTENFNMWKNNMVEQMHEDIISLWD
ESLKPCVKLTPICVTLNCTDDVRNVT-NNATNTNSSW-GEPMEKGEIKNCSFNMTTELRD
KKQKVHALFYKLDIVPL-NSNSSE----------YRLINCNTSAITQACPKVSFEPIPIH
YCAPAGFAILKCNDKKFNGTGPCTNVSTVQCTHGIRPVVSTQLLLNGSLAEEEVVIRSEN
FTNNAKTIMVQLNVSVEINCTRPNNNTRKSIHIGPGRAFYTTGDIIGDIRQAHCNISRAQ
WNNTLKHIVEKLGKQFGNNKTIVFNHSSGGDPEITTHSFNCGGEFFYCNSTKLFNSTWTR
N-NGTWTRN---DTERSNSTE---EHITLPCRIKQIVNMWQRVGQAMYAPPIRGQIRCSS
NITGLLLTRDGGNDT-----SGTEIFRPGGGDMRNNWRNELYKYKVVRIEPLGVAPTRAK
RRVVEREKRAVG-LGAVFLGFLGAAGSTMGAASLTLTVQARQVLSGIVQQQSNLLKAIEA
QQHLLKLTVWGIKQLQARVLAVERYLRDQQLLGIWGCSGKLICTTTVPWNASWSNKSLNE
IWNNMTWMEWEKEIDNYTNLIYNLLEESQNQQEKNEQDLLALDKWANLWNWFDISNWLWY
IKIFIIIVGGLIGLRIVFAVLSIINRVRQGYSPLSLQTLIPNPRGPDRPGGIEEEGGEQG
RDRSIRLVNGFLALAWDDLRNLCLFSYHRLRDLLLIVTRIVELLG-------RRGWEALK
YWWNLLQYWSQELKNSAISLLNATAVAVAEGTDRVIEALQRACRAILHIPRRIRQGLERL
LL- >ENV-M.syn3.3
MRVKETRKNYQHLWKWGTML--------LGMLMICSAAEQLWVTVYYGVPVWKEATTTLF
CASDAKAYDTEVHNVWATHACVPTDPSPQEVVLENVTENFNMWKNDMVEQMHTDIISLWD
QSLKPCVKLTPLCVTLNCTDYVKNIT-NNATSTNSSW-GKPMEKGEIKNCSFNITTSIRN
KVQKQYALFYKLDIVPI-DNDNTS----------YRLINCNTSTITQACPKVSFDPIPIH
YCAPAGYAILKCNNKTFNGTGPCNNVSTVQCTHGIKPVVSTQLLLNGSLAEGEIIIRSEN
LTNNAKTIIVHLNKSVEINCTRPNNNTRKSIRIGPGQAFYATGDIIGDIRKAHCNISGTK
WNHTLEQVMEELKKHFP-NKTIKFNSSSGGDLEITTHSFNCRGEFFYCNTSGLFNSTW--
--NDTTINR----TEGSNNTR----NITLPCRIKQIINMWQGVGRAMYAPPIAGNITCKS
NITGILLTRDGGNNN-----STNETFRPGGGDMRDNWRSELYKYKVVEIKPLGIAPTKAK
RRVVEREKRAVG-IGAVFLGFLGTAGSTMGAASITLTVQARQLLSGIVQQQSNLLRAIEA
QQHMLQLTVWGIKQLQTRVLAIERYLKDQQLLGIWGCSGKLICTTNVPWNSSWSNKSQSE
IWDNMTWMQWDREISNYTDTIYRLLEDSQNQQEKNEKDLLALDSWKNLWNWFDITNWLWY
IRIFIMIVGGLIGLRIIFAVLSIVNRVRQGYSPLSFQTRLPAPRGPDRPEGIEEEGGERD
RDRSVRLVDGFLALIWDDLRSLCLFSYHRLRDFILIAARTVELLGHSSLKGLRLGWEGLK
YLWNLLQYWIQELKNSAVSLLNATAIAVAEGTDRVIEVVQRAYRAILHIPTRIRQGLERA
LL-
```

Fig. 10 cont'd-10

>ENV-M.syn4.1
MRVKETRKNYQHLWKWGTML--------LGMLMICSAAEQLWVTVYYGVPVWKEATTTLF
CASDAKAHETEVHNIWATHACVPTDPNPQEVVLGNVTENFNMWKNDMVEQMHTDIISLWD
QSLKPCVELTPLCVTLHCTDL------GNATNT--------MEKGEIKNCSFNMTTELRD
KKQKVYALFYRLDIVPI-DNDNTS----------YRLINCNTSVIKQACPKVTFEPIPIH
YCTPAGFAILKCNDKNFNGTGPCKNVSTVQCTHGIRPVVSTQLLLNGSLAEKEIIIRSEN
LTDNAKTIIVHLNKSVEINCTRPSNNTRKSVRIGPGQTFYATGDIIGDIRQAHCNISRAK
WNNTLKQIVTKLREQFK-NKTIVFNQSSGGDLEITTHSFNCRGEFFYCNTTQLFNSTW--
--------KN---DTEVSNNTK-GNDTITLPCRIKQIVNMWQEVGRAMYAPPIEGNITCNS
NITGILLTRDGGNNGNET--NGTEIFRPGGNMRDNWRNELYKYKVVEIKPLGVAPTEAK
RRVVEREKRAVG-IGAVFLGFLGAAGSTMGAASITLTVQARQLLTGIVQQQSNLLRAIEA
QQHMLQLTVWGIKQLQTRVLAIERYLKDQQLLGLWGCSGKLICTTAVPWNSSWSNKTYND
IWDNMTWMQWDREISNYTDTIYRLLEDSQNQQEKNEKDLLALDSWKNLWNWFDITNWLWY
IKIFIMIVGGLIGLRIIFAVLSIVNRVRQGYSPLSFQTLTPNPRGPDRPGGIEEEGGEQG
RDRSIRLVNGFLALAWDDLRNLCLFSYHQLRDFILIVARAVELLGRSSLRGLQRGWEALK
YLGSLVQYWGLELKKSAISLLDTIAIAVAEGTDRVIEVVQRAYRAILHIPTRIRQGLERL
LL-
>ENV-M.syn4.2
MRVRGIQRNWPQWWIWGILG--------FWMLMICNVVGNLWVTVYYGVPVWKEAKTTLF
CASDAKAYEKEVHNVWATHACVPTDPSPQEVVLENVTENFDMWKNNMVEQMQEDVISLWD
QSLKPCVKLAPLCVTLNCTDYVKNIT-NNATSTNSSW-GKPMEKGEIKFCSFNITTSIRN
KVQKQYALFYKLDVVQM-DEDNTS----------YRLISCNTSTITQACPKVTFDPIPIH
YCAPAGFAILKCNNKTFNGTGPCTNVSTVQCTHGIKPVVSTQLLLNGSLAEEEIIIRSEN
LTNNAKTIIVHLNESVEIVCTRPNNNTRKSIHIGPGRAFYATGEIIGDIRQAHCNLSRAK
WNDTLKQIVIKLREQFG-NKTIIFNQSSGGDPEITTHSFNCGGEFFYCNSTQLFNSTWNF
--NGTWNKN----FNNTWNNTEGTNDTITLPCKIKQIINMWQRVGQAMYAPPISGQIRCSS
NITGLILTRDGGN---DT--SGTEIFRPGGGDMRDNWRSELYKYKVVKIEPLGVAPTKAK
RRVVQREKRAVG-IGALFLGFLGAAGSTMGAASMTLTVQARQLLSGIVQQQSNLLKAIEA
QQHLLQLTVWGIKQLQARILAVERYLKDQQLLGIWGCSGKLICTTTVPWNASWSNKSLNE
IWDNMTWMEWEREIDNYTGLIYNLIEESQTQQEKNEQELLELDKWASLWNWFDITKWLWY
IKIFIMIIGGLIGLRIVFTVLSIVNRVRKGYSPLSFQTLTHHQREPDRPERIEEGGGEQD
RDRSGRLVDGFLAIIWVDLRSLCLFSYHRLRDLLLIVTRIVELLG-------RRGWEVLK
YWWNLLQYWSQELKNSAVSLLNATAIAVAEGTDRIIEVIQRICRAIRNIPRRIRQGLERA
LL-
>ENV-M.syn4.3
MRVKETQMNWPNLWKWGTLI--------LGLVIICSASDNLWVTVYYGVPVWKDAETTLF
CASDAKAYDTEVHNVWATYACVPTDPNPQEIHLENVTEEFNMWKNDMVDQMHEDIISLWD
ESLKPCVKLTPLCVTLNCTDDVRNVT-NNATNTNSSW-GEPMEKGEIKNCSFNITTSIRD
KVQKEYALFYKLDVVPI-DNDSNNTN--------YRLISCNTSVITQACPKVSFEPIPIH
YCAPAGYAILKCNDKKFNGTGPCNNVSTVQCTHGIKPVVTTQLLLNGSLAEGEIIIRSEN
ITNNAKTIIVQLNESVVINCTRPNNNTRKSIRIGPGQAFYATGDIIGNIRQAHCNISRAN
WNNTLRQIVEKLGEQFGNNKTIVFNHSSGGDPEIVTHSFNCAGEFFYCNTTKLFNSTWTR
N-NGTWTRN---DTERSNSTE---EHITLPCRIKQIINMWQEVGKAMYAPPIRGQIRCSS
NITGLLLTRDGGNNN-----STNETFRPGGGNMKDNWRSELYKYKVVQIEPLGIAPTKAK
RRVVEREKRAVG-LGAVFLGFLGTAGSTMGAASLTLTVQARQVLSGIVQQQRNLLRAIEA
QQHLLKLTVWGIKQLQARVLAIERYLQDQQLLGMWGCSGKLICTTNVPWNSSWSNKSQTD
IWDNMTWLQWDKEISNYTSLIYTLIEESQNQQEKNEQDLLALDKWASLWSWFDISNWLWY
IKIFIIIVGGLIGLRIVFAVLSIINRVRQGYSPLSLQTLIPNPRGPDRLGRIEEEGGEQD
RDRSIRLVSGFLALAWDDLRSLCIFSYHRLRDFILIAARTVELLGHSSLKGLRLGWEGLK
YLGNLLLYWGQELKNSAINLLDTIAIAVAGWTDRVIEIGQRAGRAILNIPRRIRQGFERA
LL-
>ENV-M.syn4.4
MRVTGIRKNYQHLWRWGTMLLWRWGTMLLGILMICSAAGKLWVTVYYGVPVWRDADTTLF
CASDAKAYDTEAHNVWATHASVPTDPNPQEIVLENVTENFNMWKNNMVEQMHEDIISLWD
QSLKPCVQLTPLCVTLNCTN-VNVTNLKNETNTKSSSGGEKMEEGEMKNCSFNITTEIRD
KKQKVHALFYKLDIVPL-NSNSSE----------YRLINCNTSAITQACPKVSFDPIPIH

Fig. 10 cont'd-11

```
YCTPAGYAILKCNNKKFNGTGPCKNVSSVQCTHGIKPVISTQLLLNGSLAEEEVVIRSEN
FTNNAKTIMVQLNVSVEINCTRPNNNTRRSIPIGPGRAFYTTGDIIGDIRKAHCNISRAQ
WNNTLKHIVEKLGKQFGNNKTIIFKPSSGGDPEIVMHSFNCGGEFFYCNTSGLFNSTW--
----------N---STSLFNSTN---GTITLQCRIKQIINMWQGVGRAMYAPPIAGNITCKS
NITGLLLVRDGGT---EP--NDTETFRPGGGDMKDNWRSELYKYKVVRIEPLGVAPTRAK
RRVVEREKRAIG-LGAMFLGFLGAAGSTMGAASVTLTVQARLLLSGIVQQQNNLLRAIEA
QQHLLRLTVWGIKQLQARVLAVERYLRDQQLLGIWGCSGKIICTTAVPWNTSWSNRSLNE
IWNNMTWMEWEKEIDNYTNLIYNLLEESQNQQEKNEQELLALDKWANLWNWFDISNWLWY
IRIFIMIVGGLVGLRIVFAVLSIVKRVRQGYSPLSFQTRLPAPRGPDRPEGIEEEGGERD
RDRSVRLVDGFLALIWDDLRSLCLFSYHHLRDLLLIVARIVELLG-------RRGWEALK
YWWNLLQYWIQELKNSAISLLNATAVAVAEGTDRVIEALQRACRAILHIPRRIRQGFEAA
LL-
>ENV-M.syn6.1
MRVMGIQRNCQQWWIWGILG--------FWMLMICNVMGNLWVTVYYGVPVWKEANTTLF
CASDAKAYEREVHNVWATHASVPTDPNPQEVVLENVTEDFNMWKNNMVEQMQEDVISLWD
QSLQPCVKLTPLCVTLNCTD-LRNATNGNDTNTTSSS-REMMGGGEMKNCSFNITTEIRD
KKQKVYALFYKLDVVPI-DNDSNNTN--------YRLISCNTSAVTQACPKVTFDPIPIH
YCTPAGFAILKCRDKKFNGTGPCNNVSTVQCTHGIKPVVTTQLLLNGSLAEEEIVIRSEN
FTDNAKTIIVQLKEAVEINCTRPNNNTRKGIHIGPGRAFYATGEIIGDIRQAHCNVSRSE
WNKTLQQVATQLRKHF--NKTIIFNSSSGGDLEITTHSFNCRGEFFYCNTSGLFNSTW--
--NDTTINR----TEGSNNTR----NITLPCRIKQFINMWQEVGRAMYAPPIAGNITCRS
NITGLLLTRDGGNNGNET--NGTEIFRPGGGDMRNNWRSELYKYKVVEIKPLGIAPTKAR
RRVVQREKRAVG-IGAVFLGFLSAAGSTMGAASITLTVQARQLLTGIVQQQSNLLKAIEA
QQHMLQLTVWGVKQLQARVLAVERYLRDQQLLGIWGCSGRLICTTAVPWNTSWSNKSLNE
IWDNMTWMEWEREIDNYTSLIYTLIEESQNQQEKNEQELLELDKWANLWNWFSITNWLWY
IRIFIMIVGGLIGLRIIFGVLSIVKRVRQGYSPLSFQTRLPAPRGPDRPEGIEEEGGERD
RDRSGRLVDGFLALIWDDLRSLCLFSYHRLRDLILIAARIVELLGHSSLKGLRLGWEALK
YLWNLLLYWGQELKNSAISLLNTTAIVVAEGTDRVIEVLQRAGRAILNIPRRIRQGFEAA
LL-
>ENV-M.syn6.2
MRVTGIRKNYQHLWRWGTMLLWRWGTMLLGILMICSAAGKLWVTVYYGVPVWREAKTTLF
CASDAKAYEKEVHNVWATYACVPTDPNPQEMVLENVTENFNMWKNNMVDQMHEDIISLWD
ESLKPCVKLTPLCVTLHCTDL------GNATNT--------MEKGEIKNCSFNTTTEIRD
KKQKVHALFYRLDVVPI-DNDNTS----------YTLINCNTSVITQACPKVTFEPIPIH
YCAPAGFAILKCNNKKFNGTGPCTNVSTVQCTHGIRPVVSTQLLLNGSLAEGEIIIRSEN
LTDNAKTIIVHLNESVEIVCTRPNNNTRKSVRIGPGQTFYATGAIIGDIRQAYCNISRAK
WNNTLKQIVTKLREQFGNNKTIIFKPPSGGDLEITMHHFNCRGEFFYCNTTQLFNSTWNF
--NGTWNKN---FNNTWNNTEGTNDTITLPCKIKQIINMWQGVGRAMYAPPISGQIRCSS
NITGLLLTRDGGT-------NNTEIFRPGGGNMRDNWRSELYKYKVVKIEPLGVAPTKAK
RRVVQREKRAVG-IGALFLGFLGAAGSTMGAASMTLTVQARQVLSGIVQQQRNLLRAIEA
QQHLLQLTVWGIKQLQARILAVERYLKDQKFLGLWGCSGKIICTTAVPWNASWSNKSLDD
IWNNMTWMQWEREIDNYTGLIYSLIEESQTQQEKNEQELLQLDKWASLWNWFDITNWLWY
IRLFIMIVGGLVGLRIVFTVLSIVNRVRKGYSPLSFQTLTHHQREPDRPERIEEGGGEQG
RDRSVRLVSGFLALFWDDLRSLCLFCYHRLRDFILIAARTVELLGHSSLKGLRRGWEGLK
YLWNLLQYWIQELKNSAISLLNATAVAVAEGTDRVIEALQRACRAILHIPRRIRQGLERL
LL-
>ENV-M.syn6.3
MRVRGIQRNWPQWWIWGILG--------FWMIIICRVVGNLWVTVYYGVPVWKDAETTLF
CASDAKSYETEAHNIWATHACVPTDPSPQEVVLGNVTENFNMWKNDMVEQMHEDIISLWD
QSLKPCVELTPLCVTLNCTDDVRNVT-NNATNTNSSW-GEPMEKGEIKNCSFNTTSIRN
KVQKQYALFYKLDVVQI-DDNNSTNTS-------YRLINCNTSAITQACPKVSFDPIPIH
YCAPAGYAILKCNNKTFNGTGPCHNVSTVQCTHGIRPVISTQLLLNGSLAEEEVVIRSEN
FTNNAKTIMVQLNVSVEINCTRPNNNTRKSIHIGPGRAFYTTGDIIGDIRQAHCNISRAQ
WNNTLKHIVEKLGKQFGNNKTIIFKPSSGGDPEIVMHSFNCRGEFFYCNTSKLFNSTWTR
N-NGTWTRN---DTERSNSTE----EHITLPCRIKQIINMWQRVGQAMYAPPIAGNITCNS
SITGLLLTRDGGN----DT--SGTEIFRPGGGNIKDNWRSELYKYKVVQIEPLGVAPTRAK
```

Fig. 10 cont'd-12

```
RRVVEREKRAVG-IGAMIFGFLGAAGSTMGAASMALTVQARQLLSGIVQQQSNLLMAIEA
QQHLLKLTVWGIKQLRARVLAVERYLKDQQLLGIWGCSGKHICTTNVPWNSSWSNKSLDE
IWNNMTWIEWEREINNYTGLIYNLLEKSQNQQEKNEQDLLALDKWASLWSWFDISNWLWY
IKIFIIIVGGLIGLRIVFAVLSLVNRVRQGYSPLSLQTLLPTPRGPDRPEGTEEEGGEQG
RDRSIRLVSGFLALAWDDLRSLCRFSYHRLRDFILIVARTVELLGRSSLKGLRLGWEGLK
YLGNLLLYWGQELKISAISLLDTTAIAVAGWTDRVIEIGQRLCRAIRNIPRRIRQGAERA
LQ-
>ENV-M.syn6.4
MRVKETQMNWPNLWKWGTLI--------LGLVIICSASDNLWVTVYYGVPVWRDADTTLF
CASDAKAHETEVHNVWATHACVPTDPNPQEIHLENVTEEFNMWKNNMVEQMHTDIISLWD
QSLKPCVRLTPLCVTLNCTDELKNATFRSNTTTNSSW--EKMERGEIKNCSFNITTSIRD
KVQKEYALFYKLDIVPL-NSNSSE----------YRLINCNTSVIKQACPKISFDPIPIH
YCAPAGFAILKCKDKKFNGTGPCQNVSTVQCTHRIKPVVSTQFLLNGSLAEEDIIIRSEN
ITNNAKTIIVQLNESVVINCTRPNNNTRRSIPIGPGRVFYTTEDIIGDIRQAHCNLSRAK
WNDTLKQIVIKLREQFG-NKTIVFNQSSGGDLEIVMHSFNCGGEFFYCNSTQLFNSTWF-
--NSTW------STEGSNNTE-GSDTITLPCRIKQIVNMWQGVGKAMYAPPIRGQIRCSS
NITGILLTRDGGTNGT----NETETFRPGGGNMKDNWRSELYRYKVVKIEPLGIAPTKAK
RRVVEREKRAIG-LGAMFLGFLGTAGSTMGAASLTLTVQARQLMSGIVQQQNNLLRAIEA
QQHMLKLTVWGIKQLQARVLALERYLKDQQLLGLWGCSGKLICTTTVPWNSSWSNKSQTD
IWDNMTWMQWDREISNYTNTIYRLLEDSQNQQEKNEKDLLALDSWKNLWNWFDITKWLWY
IKIFIMIVGGLIGLKIVFAVLSIINRVRQGYSPLSFQTLIPNPRGPDRPGGIEEEGGEQD
RDRSIRLVNGFLALIWVDLRSLFLFSYHRLRDLLLIVTRIVELLG-------RRGWEALK
YWWNLLQYWSQELKNSAINLLDTIAIAVAEGTDRIIEVIQRICRAIRNIPTRIRQGLERA
LL-
>ENV-M.syn6.5
MRVKGIRKNYQHLWKWGTML--------LGMLMICSATEKLWVTVYYGVPVWKEATTTLF
CASDAKAYDTEVHNVWATYACVPTDPNPQELVLENVTENFDMWKNNMVEQMHEDIINLWD
QSLKPCVKLTPICVTLNCTDYVKNIT-NNATSTNSSW-GKPMEKGEIKNCSFNMTTELRD
KKQKVYSLFYKLDVVQM-DEDNTS----------YRLISCNTSVITQACPKISFEPIPIH
YCTPAGYAILKCNDKNFNGTGPCKNVSSVQCTHGIKPVISTQLLLNGSLAEEEIIIRSEN
LTNNVKTIIVHLNKSVEINCTRPSNNTRTSIRIGPGQAFYATGDIIGDIRKAHCNISRAN
WNNTLRQIVEKLGEQFGNNKTIVFNHSSGGDPEITTHSFNCGGEFFYCNTTKLFNSTWTW
N-NSTW--N---NTKRSNDTE---EIITLPCRIKQIINMWQEVGKAMYAPPIQGVIRCES
NITGLILTRDGGNNN-----STNETFRPGGGDMRDNWRSELYKYKVVRIEPLGVAPTEAK
RRVVQREKRAVGTIGAMLGFLGAAGSTMGAASVTLTVQARLLLSGIVQQQNNLLKAIEA
QQHLLRLTVWGIKQLQARVLAIERYLQDQQLLGIWGCSGKLICTTNVPWNTSWSNRSLNE
IWNNMTWMEWEKEIDNYTNLIYNLLEESQIQQEKNEQELLALDKWANLWNWFDISNWLWY
IRIFIIIVGGLVGLRIVFAVLSIVNKVRQGYSPLSFQTHLPAQRGPDRPEGIEEGGGEQD
RDRSVRLVDGFLAIIWVDLRSLCLFSYHHLRDLLLIVARIVELLG-------RRGWEVLK
YWWNLLKYWSQELKNSAVSLLNATAIAVAEGTDRIIELIQRICRAICNIPRRIRQGFERA
LL-
>ENV-M.syn6.6
MRVKETRKNYQHLWRWGIML--------LGMLMICSAAEQLWVTVYYGVPVWKEAKTTLF
CASNAKAYDTEAHNVWATHACIPTDPNPQEIVLENVTESFNMWKNDMVDQMHEDVISLWD
QSLKPCVQLTPLCVTLNCTN-VNVTNLKNETNTKSSSGGEKMEEGEMKNCSFNVTTELRD
KKKKEYALFYRLDIVPL-NEGNNSNSSY------YRLINCNTSTITQACPKVSFEPIPIH
FCAPAGFAILKCNDKKFNGTGPCKNVSTVQCTHGIKPVVSTQLLLNGSLAEKEIIIRSEN
LTNNAKIIIVQLNESVEINCTRPGNNTRKSIRIGPGQTFYATGDIIGNIRQAHCNISRTQ
WNNTLKQIAIKLREQFG-NKTIIFNQSSGGDPEIVTHSFNCGGEFFYCKSTKLFNSTW--
----------N---STSLFNSTN---GTITLQCRIKQIINRWQEVGKAMYAPPIEGNITCKS
NITGLLLVRDGGINVTNN--TGTEVFRPGGGDMKDNWRNELYKYKVVEIKPLGVAPTRAR
RRVVEREKRAVG-LGAVFLGFLGAAGSTMGAAAVTLTVQARQLLFGIVQQQSNLLRAIEA
QQRMLQLTVWGIKQLQTRVLAIERYLKDQQLLGMWGCSGKLICTTAVPWNSSWSNKTYND
IWDNMTWLQWDKEISNYTDTIYRLLEESQNQQERNEKDLLELDKWASLWNWFNITNWLWY
IKIFIMIIGGLIGLRIIFAVLSIVNRVRQGYSPLSFQTLTPNPRGPDRLGRIEEEGGEQD
KDRSIRLVNGFSALIWDDLRNLCLFSYHQLRDFILVTARAVELLGRSSLRGLQRGWEALK
YLGSLVQYWGLELKKSAISLLDTIAIAVANWTDRVIEVVQRAYRAILHIPTRIRQGFEAA
LQ-
```

Fig. 10 cont'd-13

```
>POL-B.syn1.1
FFRENLAFPQGKAREFSSEQTRANSPTRR--------------ELQVWGRDNNSLSEAGA
DR----QGTVS-FSFPQITLWQRPLVTIKIGGQLKEALLDTGADDTVLEEMNLPGRWKPK
MIGGIGGFIKVRQYDQIPIEICGHKAIGTVLVGPTPVNIIGRNLLTQIGCTLNFPISPIE
TVPVKLKPGMDGPKVKQWPLTEEKIKALVEICTEMEKEGKISKIGPENPYNTPVFAIKKK
DSTKWRKLVDFRELNKRTQDFWEVQLGIPHPAGLKKKKSVTVLDVGDAYFSVPLDKDFRK
YTAFTIPSINNETPGIRYQYNVLPQGWKGSPAIFQSSMTKILEPFRKQNPDIVIYQYMDD
LYVGSDLEIGQHRTKIEELRQHLLRWGFTTPDKKHQKEPPFLWMGYELHPDKWTVQPIVL
PEKDSWTVNDIQKLVGKLNWASQIYAGIKVKQLCKLLRGTKALTEVIPLTEEAELELAEN
REILKEPVHGVYYDPSKDLIAEIQKQGQGQWTYQIYQEPFKNLKTGKYARMRGAHTNDVK
QLTEAVQKIATESIVIWGKTPKFKLPIQKETWETWWTEYWQATWIPEWEFVNTPPLVKLW
YQLEKEPIVGAETFYVDGAANRETKLGKAGYVTDRGRQKVVSLTDTTNQKTELQAIHLAL
QDSGLEVNIVTDSQYALGIIQAQPDKSESELVSQIIEQLIKKEKVYLAWVPAHKGIGGNE
QVDKLVSAGIRKVLFLDGIDKAQEEHEKYHSNWRAMASDFNLPPVVAKEIVASCDKCQLK
GEAMHGQVDCSPGIWQLDCTHLEGKIILVAVHVASGYIEAEVIPAETGQETAYFLLKLAG
RWPVKTIHTDNGSNFTSTTVKAACWWAGIKQEFGIPYNPQSQGVVESMNKELKKIIGQVR
DQAEHLKTAVQMAVFIHNFKRKGGIGGYSAGERIVDIIATDIQTKELQKQITKIQNFRVY
YRDSRDPLWKGPAKLLWKGEGAVVIQDNSDIKVVPRRKAKIIRDYGKQMAGDDCVASRQD
ED-
>POL-B.syn3.1
FFRENLAFPQGKAREFPSEQTRANSPTSR--------------ELQVWGGDNNSLSEAGD
DR----QGTVS-FSFPQITLWQRPIVTIKIGGQQKEALLDTGADDTVLEEMNLPGRWKPK
IIGGIGGFIKVKQYDQILIEICGHKAIGTVLVGPTPANIIGRNLLTQIGCTLNFPISPIE
TVPVRLKPGMDGPKVKQWPLTEEKIKALIEICTELENEGKISKIGPENPYNTPVFAIKKK
DGTKWRKLVDFRELNKRTQDFWEVQLGIPHPAGLKKKKSVTVLDVGDAYFSVPLDKEFRK
YTAFTIPSINNETPGIRYQYNVLPQGWKGSPSIFQSSMTKILEPFRKQNPEIVIYQYMDD
LYVGSDLEIEQHRTKIEELRQHLLKWGFYTPDKKHQKEPPFLWMGYELHPDKWTVQPIVL
PEKDSWTVNDIQKLVGKLNWASQIYAGIKVKQLCRLLRGTKALTEVVPLTEEAELELAEN
REILKEPVHGVYYDPSKDLVAEIQKQGLGQWTYQIYQEPYKNLKTGKYAKMRGAHTNDVK
QLTEAVQKIATESIVIWGKTPKFRLPIQKETWEAWWMEYWQATWIPEWEFVNTPPLVKLW
YQLEKEPIVGAETFYVDGAANRDTKLGKAGYVTDRGRQKVVSLTDTTNQKTELQAIHLAL
QDSGLEVNIVTDSQYAIGIIQAQPDRSESELVSQIIEQLIKKEKVYLAWVPAHKGIGGNE
QVDKLVSSGIRKVLFLDGIDKAQEDHEKYHSNWKAMASDFNLPPVVAKEIVACCDKCQLK
GEAMHGQVDCSPGIWQLDCTHLEGKVILVAVHVASGYIEAEVIPAETGQETAYFILKLAG
RWPVTTIHTDNGSNFTSTAVKAACWWAGIKQEFGIPYNPQSQGVVESINKELKKIIKQVR
DQAEHLKTAVQMAVFVHNFKRKGGIGGYSAGERMIDIIATDIQTTELQKQITKLQNFRVY
FRDSRDPLWKGPAKLLWKGEGAVVIQDNSEIKVVPRRKAKIIRDYGKQMAGDDCVASRQD
ED-
>POL-B.syn3.2
FFREDLAFLQGKAREFSSEQTRANSPTRG--------------ELQVWGRDNNSLSEAGA
DR----QGTVS-LSFPQITLWQRPLVTVKIGGQLKEALLDTGADDTVLEEMSLPGRWKPK
MIGGIGGFIKVRQYDQILVEICGHKAIGTVLIGPTPVNIIGRDLLTQIGCTLNFPISPID
TVPVKLKPGMDGPKVKQWPLTEEKIKALVEICTEMEKEGKISKIGPENPYNTPIFAIKKK
DSTKWRKLVDFRELNRRTQDFWEVQLGIPHPAGLQKKSVTVLDVGDAYFSVPLDEDFRK
YTAFTIPSTNNETPGIRYQYNVLPQGWKGSPAIFQSSMTRILEPFRKQNPDLVIYQYMDD
LYVGSDLEIGQHRTKIEELREHLLKWGFTTPDKKHQKEPPFLWMGYELHPDKWTVQPIML
PEKDSWTVNDIQKLVGKLNWASQIYPGIKVKQLCKLLRGAKALTEVIPLTKEAELELAEN
REILKEPVHGAYYDPSKDLIAEIQKQGQGQWTYQIYQDPFKNLKTGKYARMRGAHTNDVR
QLTEAVQKITTESIVIWGKIPKFKLPIQKETWETWWTEYWQATWIPEWEFVNTPPLVKLW
YQLEKEPIIGAETFYVDGAANRETKLGKAGYVTNKGRQKVVSITDTTNQKTELQAILLAL
QDSGLEVNIVTDSQYAIGIIQAQPDKSESELVSQIIEELIKKEKVYLTWVPAHKGIGGNE
QIDKLVSAGIRKVLFLDGIDQAQEEHEKYHSNWRAMASDFNIPPVVAKEIVASCDKCQLK
GEAIHGQVDCSPGIWQLDCTHLEGKIILVAVHVASGYIEAEIIPTETGQETAYFLLKLAG
RWPVKTVHTDNGSNFTSTTVKAACWWAGVKQEFGIPYNPQSQGVVESMNNELKKIIGQIR
DQAEHLKTAVQMAVFIHNFKRKGGIGGYSAGERIVDIIATDIQTKELQKQITKIQNFRVY
YRDNRDPLWKGPAKLLWKGEGAVVIQENSDIKVVPRRKVKIIRDYGKQMAGDDCVASGQD
ED-
```

Fig. 10 cont'd-14

\>POL-B.syn3.3
FFREDLAFPQGEAREFSSEQTRANSPTRR--------------ELQVWGRDSNSLSEAGA
DR----QGTVS-FNFPQITLWQRPLVTIKIGGQLKEALLDTGADDTVLEDMNLPGKWKPK
MIGGIGGFIKVRQYDQIPIEICGHKAVGTVLVGPTPVNIIGRNLLTQLGCTLNFPISPIE
TVPVKLKPGMDGPKVKQWPLTEEKIKALVEICTELEKEGKISKIGPENPYNTPVFAIKKK
DSTKWRKVVDFRELNKKTQDFWEVQLGIPHPSGLKKKKSVTVLDVGDAYFSVPLDKDFRK
YTAFTIPSVNNETPGVRYQYNVLPQGWKGSPAIFQCSMTKILEPFRKQNPDIVIYQYMDD
LYVGSDLEIGQHRAKIEELRQHLLRWGFTTPDKKHQNEPPFLWMGYELHPDKWTVQPIEL
PEKDSWTVNDIQKLVGKLNWASQIYPGIKVRQLCKLLRGTKALTEVIPLTEEAELELAEN
REILREPVHGVYYDPTKDLIAEIQKQEQGQWTYQIYQEPFKNLKTGKYARTRGAHTNDVK
QLTEAVQKVATESIVIWGKTPKFKLPIQKETWEAWWTEYWQATWIPEWEFVNTPPLVKLW
YQLEKEPIEGAETFYVDGASNRETKLGKAGYVTNRGRQKVVPLTDTTNQKTELQAIYLAL
QDSGSEVNIVTDSQYALGIIQAQPDKSESELVNQIIEQLIKKEKIYLAWVPAHKGIGGNE
QVDKLVSAGIRKILFLDGIDKAQEEHEKYHNNWRAMASDFNLPPIVAKEIVASCDKCQLK
GEAIHGQVDCSPGIWQLDCTHLEGKVILVAVHVASGYIEAEVIPAETGQETAYFILKLAG
RWPVKTIHTDNGSNFTSATVKAACWWAGIKQEFGIPYNPQSQGVVESMNKELKKIIGQVR
DQAEHLKTAVQMAVFIHNFKRKGGIGEYSAGERIIDIIATDIQTRELQKQITKIQNFRVY
YRDSRDPLWKGPAKLLWKGEGAVVIQDNSDIKVVPRRKAKIIRDYGKQMAGDDCVAGRQD
ED- \>POL-B.syn4.1
FFRENLAFPQGEAREFSSEQNRANSPTRR--------------ELQVWGGDNNSLSEAGA
DR----QGTVS-LSFPQITLWQRPLVTIRIGGQLKEALLDTGADDTVLEEMSLPGRWKPK
MIGGIGGFIKVRQYDQILIEICGHKAIGTVLIGPTPVNIIGRNLLTQLGCTLNFPISPID
TVPVKLKPGMDGPKVKQWPLTEEKIKALVEICTEMEKEGKISKIGPENPYNTPIFAIKKK
DSTKWRKLVDFRELNRRTQDFWEVQLGIPHPSGLKKKKSVTVLDVGDAYFSVPLDKDFRK
YTAFTIPSINNETPGVRYQYNVLPQGWKGSPAIFQSSMTKILEPFRKQNPDMVIYQYMDD
LYVGSDLEIGQHRTKIEELRQHLLRWGLTTPDKKHQKEPPFLWMGYELHPDKWTVQPIKL
PEKDSWTVNDIQKLVGKLNWASQIYAGIKVRQLCKLLRGAKALTEVIPLTAEAELELAEN
REILREPVHGVYYDPSKDLIAEIQKQGQGQWTYQIYQDPFKNLKTGKYAKMRGAHTNDVK
QLTEAVQKVATESIVIWGKTPKFRLPIQKETWEAWWTEYWQATWIPEWEFVNTPPLVKLW
YQLEKEPIEGAETFYVDGAANRDTKLGKAGYVTDRGRQKVVSLTDTTNQKTELQAIHLAL
QDSGLEVNIVTDSQYALGIIQAQPDKSESELVSQIIEELIKKEKVYLAWVPAHKGIGGNE
QIDKLVSAGIRRVLFLDGIDQAQEEHEKYHSNWRAMASDFNLPPIVAKEIVASCDKCQLK
GEAIHGQVDCSPGIWQLDCTHLEGKIILVAVHVASGYIEAEVIPAETGQETAYFLLKLAG
RWPVKTIHTDNGSNFTSTTVKAACWWAGIKQEFGIPYNPQSQGVVESMNKELKKIIEQVR
DQAEHLKTAVQMAVFIHNFKRKGGIGEYSAGERIIDIIATDIQTRELQKQITKIQNFRVY
YRDNRDPLWKGPAKLLWKGEGAVVIQDNSDIKVVPRRKAKIIRDYGKQMAGDDCVAGRQD
ED- \>POL-B.syn4.2
FFRENLAFPQGKAREFPSEQTRANSPTSR--------------ELQVWGRDNNSLSEAGD
DR----QGTVS-FSFPQITLWQRPLVTVKIGGQLKEALLDTGADDTVLEEMNLPGRWKPK
MIGGIGGFIKVRQYDQIPIEICGHKAVGTVLVGPTPVNIIGRDLLTQIGCTLNFPISPIE
TVPVKLKPGMDGPKVKQWPLTEEKIKALIEICTELENEGKISKIGPENPYNTPVFAIKKK
DGTKWRKLVDFRELNKRTQDFWEVQLGIPHPAGLKQKKSVTVLDVGDAYFSVPLDKEFRK
YTAFTIPSTNNETPGIRYQYNVLPQGWKGSPAIFQCSMTKILEPFRKQNPDLVIYQYMDD
LYVGSDLEIEQHRTKIEELREHLLKWGFTTPDKKHQNEPPFLWMGYELHPDKWTVQPIML
PEKDSWTVNDIQKLVGKLNWASQIYAGIKVKQLCKLLRGTKALTEVVPLTEEAELELAEN
REILKVPVHGVYYDPSKDLVAEIQKQGLGQWTYQIYQEPFKNLKTGKYARTRGAHTNDVR
QLTEAVQKIATESIVIWGKTPKFKLPIQKETWEAWWMEYWQATWIPEWEFVNTPPLVKLW
YQLEKEPIVGAETFYVDGAANRETKLGKAGYVTDKGRQKVVPLTDTTNQKTELQAINLAL
QDSGSEVNIVTDSQYAIGIIQAQPDRSESELVSQIIEQLINKEKVYLAWVPAHKGIGGNE
QVDKLVSSGIRKVLFLDGIDKAQEDHEKYHSNWRAMAGDFNLPPVVAKEIVACCDKCQLK
GEAMHGQVDCSPGIWQLDCTHLEGKVILVAVHVASGYIEAEVIPAETGQETAYFILKLAG
RWPVKTVHTDNGSNFISTTVKAACWWAGVKQEFGIPYNPQSQGVVESMNNELKKIIGQVR
DQAEHLKTAVQMAVFVHNFKRKGGIGGYTAGERIVDIIASDIQTKELQKQITKIQNFRVY

Fig. 10 cont'd-15

```
YRDSRDPIWKGPAKLLWKGEGAVVIQDNSEIKVVPRRKAKIIRDYGKQMAGDDCVASRQN
ED-
>POL-B.syn4.3
FFREDLAFLQGKAREFSSEQTRANSPTRR--------------ELQVWGRDNNSPSEAGA
DR----QGTVS-FNFPQITLWQRPIVTIKIGGQLKEALLDTGADDTVLEDMNLPGKWKPK
MIGGIGGFIKVRQYDQILVEICGHKAIGTVLVGPTPANIIGRNLLTQIGCTLNFPISPIE
TVPVKLKSGMDGPKVKQWPLTEEKIKALIEICTEMEKEGKISKIGPENPYNTPVFAIKKK
DSTKWRKLVDFRELNKRTQDFWEVQLGIPHPSGLKKKKSVTVLDVGDAYFSVPLDEDFRK
YTAFTIPSVNNETPGIRYQYNVLPQGWKGSPAIFQSSMTRILEPFRKQNPDIVIYQYMDD
LYVGSDLEIGQHRAKIEELRQHLLRWGFTTPDKKHQKEPPFLWMGYELHPDKWTVQPIEL
PEKDSWTVNDIQKLVGKLNWASQIYPGIKVRQLCKLLRGTKALTEVIPLTEEAELELAEN
REILKEPVHGVYYDPSKELIAEIQKQEQGQWTYQIYQEPFKNLKTGKYARMRGTHTNDVK
QLTEAVQKITTESIVIWGRTPKFKLPIQKETWESWWTEYWQATWIPEWEFVNTPPLVKLW
YQLEREPIAGAETFYVDGASNRETKLGKAGYVTNRGRQKVVSLPDTTNQKTELQAIYLAL
QDSGLEVNIVTDSQYAIGIIQAQPDKSESELVNQIIEQLIKKEKIYLAWVPAHKGIGGNE
QVDKLVSNGIRKILFLDGIDKAQDEHEKYHSNWKAMASDFNLPPVVAKEIVACCDKCQLK
GEAMHGQVDCSPGIWQLDCTHLEGKIIILVAVHVASGYIEAEVIPAETGQETAYFLLKLAG
RWPVKIIHTDNGSNFTSTAVKAACWWAGIKQEFGIPYNPQSQGVVESINKELKKIIKQVR
DQAEHLKTAVQMAVFIHNFKRKGGIGGYSAGERMIDIIATDIQTTELQKQITKLQNFRVY
FRDSRDPLWKGPAKLLWKGEGAVVIQDNNDIKVVPRRKVKIIRDYGKQMAGDDCVASGQD
ED-
>POL-B.syn4.4
FFREDLAFPQGKARELSSEQTRANSPTRG--------------ELQVWGRDSNSLSEAGA
DR----PGTVS-FSFPQITLWQRPLVTIKIGGQQKEALLDTGADDTVLEEINLPGRWKPK
IIGGIGGFIKVKQYDQIPIEICGHKVIGTVLVGPTPANIIGRNLLTQLGCTLNFPISPIE
TVPVRLKPGMDGPKVKQWPLTEEKIKALVEICTELEKEGKISKIGPENPYNTPVFAIKKK
DSTKWRKVVDFRELNKKTQDFWEVQLGIPHPAGLKKKKSVTVLDVGDAYFSVPLDENFRK
YTAFTIPSINNETPGIRYQYNVLPQGWKGSPSIFQSSMTKILEPFRKQNPEIVIYQYMDD
LYVGSDLELGQHRTKIEELRQHLLKWGFYTPDKKHQKEPPFLWMGYELHPDKWTVQPIVL
PEKDSWTVNDIQKLVGKLNWASQIYPGIKVKQLCRLLRGAKALTEVIPLTKEAELELAEN
REILKEPVHGAYYDPTKDLIAEIQKQGEGQWTYQIYQEPYKNLKTGKYARMRGAHTNDVK
QLTETVQKITTESIVIWGKIPKFKLPIQKETWETWWTEYWQATWIPEWEFVNTPPLVKLW
YQLEKEPIIGAETFYVDGAASRETKLGKAGYVTNKGRQKVVSITDTTNQKTELQAILLAL
QDSGLEVNIVTDSQYAIGIIQAQPDKSESEIVSQIIEQLIKKEKVYLTWVPAHKGIGGNE
QVDKLVSAGIRKVLFLDGIDKAQEEHEKYHNNWRAMASDFNIPPVVAKEIVASCDKCQLK
GEAMHGQVDCSPGIWQLDCTHLEGKVILVAVHVASGYIEAEIIPTETGQETAYFILKLAG
RWPVTTIHTDNGSNFTSATVKAACWWAGVKQEFGIPYNPQSQGVIESMNKELKKIIGQIR
DQAEHLKTAVQMAVFIHNFKRKGGIGGYSAGERIVDIIATDIQTKELQNQITKIQNFRVY
YRDSRDPLWKGPAKLLWKGEGAVVIQENSDIKVVPRRKVKIIRDYGKQMAGDDCVASRQD
ED-
>POL-B.syn6.1
FFREDLAFPQGEAREFCSEQTRANSPATR--------------ELQVWGRDNTSLSEAGA
DR----PGTVS-FSFPQITLWQRPIVTVKIEGQLKEALLDTGADDTVLEEMNLPGKWKPK
MIGGIGGFIKVRQYDQVSIEICGHKAIGTVLVGPTPANIIGRNLLTQIGCTLNFPISPIE
TVPVKLKPGMDGPKVKQWPLTEEKIKALVEICTELEKEGKISKIGPENPYNTPVFAIKKK
DSTKWRKVVDFRELNKRTQDFWEVQLGIPHPSGLKKKKSVTVLDVGDAYFSVPLDENFRK
YTAFTIPSINNETPGIRYQYNVLPQGWKGSPAIFQSSMTKILEPFRKQNPDIIIYQYMDD
LYVGSDLEIGQHRAKIEELRQHLLKWGFTTPDKKHQKEPPFLWMGYELHPDKWTVQPIEL
PEKDSWTVNDIQKLVGKLNWASQIYAGIKVKELCKLLRGTKALTEVVPLTEEAELELAEN
REILKEPVHGVYYDPSKDLIAELQKQGQGQWTYQIYQEPYKNLKTGKYARTRGAHTNDVR
QLTEAVQKIATEGIVIWGKTPKFKLPIQKETWEAWWTEYWQATWIPEWEFVNTPPLVKLW
YQLEKEPILGAETFYVDGASNRETKLGKAGYVTDRGRQKVVSLDTTNQKTELQAINLAL
QDSGLEVNIVTDSQYALGIIQAQPDRSESELVSQIIEQLINKEKVYLAWVPAHKGIGGNE
QVDKLVSTGIRRVLFLDGIDKAQEEHEKYHSNWRAMASDFNLPPIVAKEIVASCDKCQLK
GEAIHGQVDCSPGIWQLDCTHLEGKVILVAVHVASGYIEAEVIPAETGQETAYFILKLAG
```

Fig. 10 cont'd-16

```
RWPVKTIHTDNGSNFTSTTVKAACWWAGIKQEFGIPYNPQSQGVVESMNKELKKIIEQVR
DQAEHLKTAVQMAVFVHNFKRKGGIGEYSAGERIVDIIATDIQTKELQKHITKIQNFRVY
YRDSRDPLWKGPAKLLWKGEGAVVIQDNSEIKVVPRRKAKIIRDYGKQMAGDDCVASRQD
ED-
>POL-B.syn6.2
FFREDLAFPQGKARELSSEQTRANSPTSPTRG----------ELQVWGRDSNSLSEAGA
DR----QGPVS-FSFPQITLWQRPIVTIKIGGQLKEALLDTGADDTVLEDMNLPGRWKPK
MIGGIGGFIKVKQYDEILVEICGHKAIGTVLIGPTPVNIIGRNLLTQLGCTLNFPISPIE
TVPVKLKSGMDGPKVKQWPLTEEKIKALVEICTELEKEGKISKIGPENPYNTPIFAIKKK
DSTKWRKLVDFRELNKRTQDFWEVQLGIPHPAGLKKKKSVTVLDVGDAYFSVPLDKDFRK
YTAFTIPSVNNETPGIRYQYNVLPQGWKGSPAIFQCSMTKILEPFRKQNPDMVIYQYMDD
LYVGSDLEIGQHRIKIEELREHLLKWGFTTPDKKHQNEPPFLWMGYELHPDKWTVQPIVL
PEKDSWTVNDIQKLVGKLNWASQIYPGIKVRQLCKLLRGTKALTEVIPLTEEAELELAEN
REILREPVHGVYYDPTKDLIAEIQKQGQGQWTYQIYQEPFKNLKTGKYARMRGAHTNDVK
QLTEAVQKITTESIVIWGKIPKFRLPIQKETWEAWWIEYWQATWIPEWEFVNTPPLVKLW
YQLEREPIAGAETFYVDGAANRETKLGKAGYVTNRGRQKVVSITDTTNQKTELQAILLAL
QDSGLEVNIVTDSQYALGIIQAQPDKSESELVNQIIEQLIKKEKIYLAWVPAHKGIGGNE
QIDKLVSAGIRKVLFLDGIDKAQDEHEKYHSNWRAMAGDFNLPPVVAKEIVACCDKCQLK
GEAMHGQVDCSPGIWQLDCTHLEGKIILVAVHVASGYIEAEVIPAETGQETAYFLLKLAG
RWPVTTIHTDNGSNFTSATVKAACWWAGVKQEFGIPYNPQSQGVIESMNKELKKIIGQVR
DQAEHLKTAVQMAVFIHNFKRKGGIGEYSAGERIIDIIATDIQTKELQKQITKIQNFRVY
YRDSRDPIWKGPAKLLWKGEGAVVIQDNSEIKVVPRRKAKIIRDYGKQMAGDDCVAGRQD
ED-
>POL-B.syn6.3
FFRENLAFPQGEAREFSSEQTRANSPTRG--------------ELQVWGRDSNSLSEAGD
DR----QGTVS-FSFPQITLWQRPLVTIKIGGQQKEALLDTGADDTVLEEMNLPGRWKPK
IIGGIGGFIKVTQYDQIPIEICGHKAVGTVLVGPTPVNIIGRDLLTQIGCTLNFPISPIE
TVPVKLKSGMDGPKVKQWPLTEEKIKALIEICTEMEKEGKISKIGPENPYNTPVFAIKKK
DGTKWRKLVDFRELNKKTQDFWEVQLGIPHPAGLKQKKSVTVLDVGDAYFSVPLDREFRK
YTAFTIPSLNNETPGIRYQYNVLPQGWKGSPSIFQSSMTKILEPFRKQNPDLVIYQYMDD
LYVGSDLELGQHRTKIEELRQHLLKWGFYTPDKKHQKEPPFLWMGYELHPDKWTVQPIKL
PEKDSWTVNDIQKLVGKLNWASQIYPGIKVKQLCRLLRGAKALTEVVPLTKEAELELAEN
REILKEPVHGAYYDPTKDLIAEVQKQELGQWTYQIYQEPFKNLKTGKYARMKGAHTNDVK
QLTETVQKITTESIVIWGKTPKFRLPIQKETWESWWTEYWQATWIPEWEFVNTPPLVKLW
YQLEKEPITGAETFYVDGAANRETKIGKAGYVTDKGRQKVVSLPDTTNQKTELQAIHLAL
QDSGSEVNIVTDSQYAIGIIQAQPDRSESEVVNQIIEQLIKKEKVYLAWVPAHKGIGGNE
QVDKLVSNGIRKILFLDGIDKAQEEHERYHSNWKAMASDFNLPPVVAKEIVACCDKCQLK
GEAIHGQVDCSPGIWQLDCTHLEGKVILVAVHVASGYIEAEVIPAETGQETAYFILKLAG
RWPVKIIHTDNGSNFTSTAVKAACWWAGIKQEFGIPYNPQSQGVVESINKELKKIIKQVR
DQAEHLKTAVQMAVFIHNFKRKGGIGGYSAGERIIDIIASDIQTKELQNQITKIQNFRVY
YRDSRDPVWKGPAKLLWKGEGAVVIQDNSDIKVVPRRKAKIIRDYGKQMAGDDCVASRQN
ED-
>POL-B.syn6.4
FFRENLAFPQRKAREFSSEQTRANSPTRR--------------ELQVWGGDNNSLSEAGA
DR----QGTVS-LSFPQITLWQRPLVTIKVGGQLKEALLDTGADDTVLEEINLPGRWKPK
MIGGIGGFIKVRQYDQILVEICGHKAIGTVLVGPTPVNIIGRNLLTQIGCTLNFPISPIE
TVPVKLKPGMDGPKVKQWPLTEEKIKALVEICTEMEKEGKISKIGPENPYNTPIFAIKKK
DSTKWRKLVDFRELNRRTQDFWEVQLGIPHPAGLKKKKSVTVLDVGDAYFSVPLDEDFRK
YTAFTIPSINNETPGVRYQYNVLPQGWKGSPAIFQASMTKILEPFRKQNPDIVIYQYMDD
LYVGSDLEIGQHRIKIEELRQHLLRWGLTTPDKKHQKEPPFLWMGYELHPDKWTVQPIML
PEKDSWTVNDIQKLVGKLNWASQIYAGIKVRQLCKLLRGAKALTEVIPLTAEAELELAEN
REILKVPVHGVYYDPSKELIAEIQKQEQGQWTYQIYQDPFKNLKTGKYARMRGTHTNDVR
QLTEAVQKITTESIVIWGKIPKFKLPIQKETWETWWTEYWQATWIPEWEFVNTPPLVKLW
YQLEKEPIIGAETFYVDGAASRETKLGKAGYVTDRGRQKVISLTDTTNQKTELQAIHLAL
QDSGVEVNIVTDSQYALGIIQAQPDKSESEIVSQIIEQLIKKEKVYLTWVPAHKGIGGNE
```

Fig. 10 cont'd-17

```
QVDKLVSTGIRKVLFLDGIDQAQEEHEKYHSNWRTMASDFNLPPIVAKEIVASCDKCQLK
GEAMHGQVDCSPGIWQLDCTHLEGKVILVAVHVASGYIEAEVIPAETGQETAYFLLKLAG
RWPVKTIHTDNGPNFISTTVKAACWWAGIKQEFGIPYNPQSQGVVESMNNELKKIIGQVR
EQAEHLKTAVQMAVFIHNFKRKGGIGGYSAGERMIDIIATDIQTTELQKQITKLQNFRVY
FRDSRDPLWKGPAKLLWKGEGAVVIQENSDIKVVPRRKAKIIRDYGKQMAGDDCVAGRQD
ED-
>POL-B.syn6.5
FFRENLAFPQGKAREFPSEQTRANSPTSR-------------ELQVWGRDNNSLSEAGA
NR----QGTVS-FSFPQITLWQRPLVTVKIGGQLKEALLDTGADDTVLEDMDLPGRWKPK
MIGGIGGFIKVRQYDQIPIEICGHKVIGTVLVGPTPANIIGRNLLTQIGCTLNFPISPIE
TVPVRLKPGMDGPKVKQWPLTEEKIKALVEICTELEKEGKISKIGPENPYNTPVFAIKKK
DSTKWRKLVDFRELNKKTQDFWEVQLGIPHPSGLKKKKSVTVLDVGDAYFSVPLDKEFRK
YTAFTIPSTNNETPGIRYQYNVLPQGWKGSPAIFQASMTKILEPFRKQNPEIVIYQYMDD
LYVGSDLEIEQHRTKIEELRQHLLRWGFTTPDKKHQKEPPFLWMGYELHPDKWTVQPIVL
PDKDSWTVNDIQKLVGKLNWASQIYPGIKIRQLCKLLRGAKALTEVIPLTKEAELELAEN
REILKEPVHGVYYDPSKDLIAEIQKQGEGQWTYQIYQEPFKNLKTGKYAKMRGAHTNDVK
QLTEAVQKVATESIVIWGKTPKFKLPIQKETWEAWWMEYWQATWIPEWEFVNTPPLVKLW
YQLEKEPIEGAETFYVDGAANRDTKLGKAGYVTNKGRQKVVTLTDTTNQKTELQAIHLAL
QDSGLEVNIVTDSQYALGIIQAQPDKSESEIVNQIIEQLIKKEKVYLAWVPAHKGIGGNE
QVDKLVSSGIRKVLFLDGIDKAQEDHEKYHSNWRAMANDFNLPPVVAKEIVACCDKCQLK
GEAMHGQVDCSPGIWQLDCTHLEGKVILVAVHVASGYIEAEVIPAETGQETAYFILKLAG
RWPVKTVHTDNGSNFTSNTVKAACWWAGIKQEFGIPYNPQSQGVVESMNKQLKQIIGQVR
DQAEHLKTAVQMAVFIHNFKRKGGIGGYTAGERIVDIIATDIQTRELQKQITKIQNFRVY
YRDSREPLWKGPAKLLWKGEGAVVIQDNSDIKVVPRRKAKIIRDYGKQMAGDDCVASGQD
ED-
>POL-B.syn6.6
FFREDLAFLQGKAREFSSEQTRAISPTRR-------------ELQVWGRDNNSPSEAGA
DR----QGTVS-FNFPQITLWQRPLVTIRIGGQLKEALLDTGADDTVLEEMSLPGRWKPK
MIGGIGGFIKVRQYDQILIEICGHKAVGTVLIGPTPVNIIGRNLLTQIGCTLNFPISPID
TVPVKLKPGMDGPKVKQWPLTEEKIKALIEICTELENEGKISKIGPENPYNTPIFAIKKK
DSTKWRKLVDFRELNKRTQDFWEVQLGIPHPSGLKKKKSVTVLDVGDAYFSIPLDEDFRK
YTAFTIPSINNETPGTRYQYNVLPQGWKGSPAIFQSSMTRILEPFRKQNPDIVIYQYVDD
LYVGSDLEIGQHRTKIEELREHLLRWGFTTPDKKHQKEPPFLWMGYELHPDKWTVQPITL
PEKDSWTVNDIQKLVGKLNWASQIYAGIKVKQLCKLLRGTKSLTEVVPLTAEAELELAEN
REILKEPVHGAYYDPSKDLVAEIQKQGLGQWTYQIYQEPFKNLKTGKYAKMRGTHTNDVK
QLTEAVQKIATESIVIWGRTPKFKLPIQKETWDAWWTEYWQATWIPEWEFVNTPPLVKLW
YQLEKEPIVGAETFYVDGAANRETRLGKAGYVTDRGRQKVVPLTDTTNQKTELQAIYLAL
QDSGLEVNIVTDSQYALGIIQAQPDKSESELVSQIIEELIKKEKVYLAWVPAHKGIGGNE
QVDKLVSAGIRRVLFLDGIDKAQEEHEKYHNNWRAMASDFNIPPVVAKEIVASCDKCQLK
GEAIHGQVDCSPGIWQLDCTHLEGKIILVAVHVASGYIEAEIIPTETGQETAYFLLKLAG
RWPVKTIHTDNGRNFTSNSVKAACWWAGIKQEFGIPYNPQSQGVVESMNRELKKIIGQIR
DQAEHLKTAVQMAVFIHNFKRKGGIGGYSAGERIVDIIASDIQTKELQKQITKIQNFRVY
YRDNRDPLWKGPAKLLWKGEGAVVIQDNNDIKVVPRRKVKIIRDYGKQMAGDDCVASRQD
ED-
>POL-C.syn1.1
FFRENLAFPQGEAREFPSEQTRANSPTSRANSPTSR-------ELQV--RGDNPRSEAGA
ER----QGT---LNFPQITLWQRPLVSIKVGGQIKEALLDTGADDTVLEEINLPGKWKPK
MIGGIGGFIKVRQYDQILIEICGKKAIGTVLVGPTPVNIIGRNMLTQLGCTLNFPISPIE
TVPVKLKPGMDGPKVKQWPLTEEKIKALTAICEEMEKEGKITKIGPENPYNTPVFAIKKK
DSTKWRKLVDFRELNKRTQDFWEVQLGIPHPAGLKKKKSVTVLDVGDAYFSVPLDEGFRK
YTAFTIPSINNETPGIRYQYNVLPQGWKGSPAIFQSSMTKILEPFRAQNPEIVIYQYMDD
LYVGSDLEIGQHRAKIEELREHLLKWGFTTPDKKHQKEPPFLWMGYELHPDKWTVQPIQL
PEKDSWTVNDIQKLVGKLNWASQIYPGIKVRQLCKLLRGAKALTDIVPLTEEAELELAEN
REILKEPVHGVYYDPSKDLIAEIQKQGHDQWTYQIYQEPFKNLKTGKYAKMRTAHTNDVK
```

Fig. 10 cont'd-18

```
QLTEAVQKIAMESIVIWGKTPKFRLPIQKETWETWWTDYWQATWIPEWEFVNTPPLVKLW
YQLEKEPIAGAETFYVDGAANRETKIGKAGYVTDRGRQKIVSLTETTNQKTELQAIQLAL
QDSGSEVNIVTDSQYALGIIQAQPDKSESELVNQIIEQLIKKERVYLSWVPAHKGIGGNE
QVDKLVSSGIRKVLFLDGIDKAQEEHEKYHSNWRAMASEFNLPPIVAKEIVASCDKCQLK
GEAIHGQVDCSPGIWQLDCTHLEGKIILVAVHVASGYIEAEVIPAETGQETAYYILKLAG
RWPVKVIHTDNGSNFTSAAVKAACWWAGIQQEFGIPYNPQSQGVVESMNKELKKIIGQVR
DQAEHLKTAVQMAVFIHNFKRKGGIGGYSAGERIIDIIATDIQTKELQKQIIKIQNFRVY
YRDSRDPIWKGPAKLLWKGEGAVVIQDNSDIKVVPRRKVKIIKDYGKQMAGADCVAGRQD
EDQ
>POL-C.syn3.1
FFRENLAFPQGEAREFPPEQTRANSPT-RANSPTSR-------KLQV--RGDNPCSEAGA
ER----QGT---FNFPQITLWQRPLVTIKVGGQVKEALLDTGADDTVLEEINLPGKWKPK
MIGGIGGFIKVRQYDQIVIEICGKKAIGTVLIGPTPVNIIGRNMLTQLGCTLNFPISPIE
TVPVKLKPGMDGPKIKQWPLTEEKIKALTAICDEMEKEGKIEKIGPENPYNTPIFAIKKK
DSTKWRKLVDFKELNKRTQDFWEVQLGIPHPAGLKKKRSVTVLDVGDAYFSVPLDESFRK
YTAFTIPSINNETPGIRYQYNVLPQGWKGSPAIFQSSMTRILEPFRAKNPEIVIYQYMDD
LYIGSDLEIGQHRAKVEELREHLLRWGFTTPDKKHQKEPPFLWMGYELHPDKWTVQPIQL
PEKDSWTVNDIQRLVGKLNWASQIYPGIKVRQLCKLLRGTKALTDIVPLTEEAELELAEN
REILKEPVHGVYYDPSKDLIAEIQKQGDDQWTYQIYQESFKNLKTGKYAKMRSAHTNDVK
QLTEAVQKIALESIVIWGKAPKFRLPIQKETWEIWWTDYWQATWIPDWEFVNTPPLVKLW
YQLEKEPIAGAETFYVDGAANRETKIGKAGYVTDRGRQKVVTLTETTNQKTELQAIQLAL
QDSGLEVNIVTDSQYALGIIQAQPDKSESELVNQIIEELIKKERVYLSWVPAHKGIGENE
QVDKLVSNGIRKVLFLDGIDKAQEEHEKYHSNWRAMANEFNLPPVVAKEIVASCDKCQLK
GEAIHGQVDCSPGMWQLDCTHLEGKVILVAVHVASGYVEAEVIPAETGQETAYFILKLAG
RWPVKIIHTDNGSNFTSNAVKAACWWAGIQQEFGIPYNPQSQGVVESMNKELKKIIGQVR
EQAEHLKTAVQMAVFIHNFKRRGGIGGYSAGERIIDIIASDIQTKELQKQITKIQNFRVY
YRDSRDPVWKGPAKLLWKGEGAVVIQDNGDIKVVPRRKAKIIKDYGKQMAGDDCVAGRQD
EDQ
>POL-C.syn3.2
FFRENLAFQQGEAREFPSEQTRANSPTSRANSPTSRTNSPTSRELQV--RGDNPRSEAGV
ER----QGT---LNFPQITLWQRPLVSIKVGGQIKEALLDTGADDTVLEDINLPGKWKPR
MIGGIGGFIKVRQYDQIPIEICGKKAIGTVLVGPTPVNIIRRNMLTQLRCTLNFPISPIK
TVPVKLKPGMDGPKVKQWPLTEEKIKALTEICEEMEKEGKITKIGPENPYNTPVFAIKKK
DSTKWRKLVDFRELNKRTQDFWEVQLGIPHPSGLKKKKSVTVLDVEDAYFSVPLDEGFRK
YTAFTIPSTNNETPGIRYQYNVLPQGWKGSPAIFQCSMTKILEPFRTQNPDIVIYQYMDD
LYVGSDLEIGQHRAKIEELRAHLLKWGLTTPDKKHQKEPPFLWMGYELHPDKWTVQPIKL
PEKDSWTVNDIQKIVGKLNWASQIYPGIKVKQLCKLLRGAKALTDIIPLTEEAELELAEN
REILKEPVHGAYYDPSKDLVAEIQKQGHDQWTYQIYQEPYKNLKTGKYAKMRTAHTNDVR
QLTEAVQKIAQESIVIWGKTPKFRLPIQKETWETWWTDYWQATWIPEWEFINTPPLVKLW
YQLEKEPIVGAETFYVDGAANRETKMGKAGYVTDKGRQKIVSLTETTNQKAELQAIQLAL
QDSGPEVNIVTDSQYALGIIQAQPDRSESELVNQIIEQLINKERIYLSWVPAHKGIGGNE
QVDKLVSSGIRKVLFLDGIDKAQEDHEKYHNNWRAMASDFNLPPIVAREIVASCDKCQLK
GEAMHGQVDCSPGVWQLDCTHLEGKIILVAVHVASGYMEAEVIPAETGQETAYYILKLAG
RWPVKVIHTDNGSNFTSTAVKAACWWAGIKQEFGIPYNPQSQGVVEAMNKELKKIIEQVR
DQAEHLKTAVQMAVLIHNFKRKGGIGGYSAGERIVDIIATDIQTRELQKQIIQIQNFRVY
YRDSRDPIWKGPAKLLWKGEGAVVIQDNSDIKVVPRRKVKIIKDYGKQMAGADCVASRQD
ED-
>POL-C.syn3.3
FFRENLAFPQGKAREFPSEQARANSPTSRANSPTSR-------ELQV--RRDNPRSEAGA
ER----QGT---LNCPQITLWQRPLVSIKIGGQTREALLDTGADDTVLEEISLPGKWKPK
MIGGIGGFIKVRQYDQILIEICGKKAIGSVLVGPTPVNIIGRNLLTQLGCTLNFPISPIE
TIPVKLKPGMDGPRVKQWPLTEEKIKALTAICEEMEKEGKISKIGPENPYNTPIFAIKKK
DSTKWRKLVDFRELNKRTQDFWEIQLGIPHPAGLKKKKSVTVLDVGDAYFSVPLDEDFRK
YTAFTIPSINNATPGIRYQYNVLPQGWKGSPSIFQSSMTKILEPFRAQNPEIVIYQYMDD
LYVGSDLEIEQHRAKIEELREHLLKWGFTTPDKKHQKEPPFLWMGCELHPDKWTVQPIQL
```

Fig. 10 cont'd-19

```
PEKESWTVNDIQKLVGKLNWASQIYAGIKVKQLCRLLRGAKALTDIVPLTAEAELELAEN
REILREPVHGVYYDPSKELIAEIQKQGQDQWTYQIYQEPFKNLKTGKYAKRRTAHTNDVK
QLAEAVQKIAMESIVIWGKIPKFRLPIQKETWEAWWTDYWQATWIPEWEFVNTPPLVKLW
YQLEKDPIAGVETFYVDGAANRETKLGKAGYVTDRGRQKIVSLSETTNQKTELHAIQLAL
QDSGSEVNIVTDSQYALRIIQAQPDKSESEIVNQIIEQLIKKERVYLAWVPAHKGIGENE
QVDKLVSKGIRKVLFLDGIEKAQEEHERYHSNWRAMASEFNLPPIVAKEIVASCDKCQLK
GEATHGQVDCSPGIWQLDCTHLEGKVIIVAVHVASGYIEAEVIPAETGQETAYFLLKLAG
RWPVKTIHTDNGSNFTSAAVKAACWWAGIHQEFGIPYNPQSQGVVESMNKELKKIIGQVR
DQAEHLKTAVLMAVFIHNFKRKGGIGDYSAGERIIDIIATDIQTKELQKQIIKIQNFRVY
YRDNRDPIWKGPAKLLWKGEGAVVLQDNSDIKVIPRRKAKIIRDYGKQMAGADCVAGRQD
ENQ

>POL-C.syn4.1
FFRENLAFPQGKAREFPSEQARANSPTSRANSPTSR-------ELQV--RRDNPRSEAGA
ER----QGT---LNLPQITLWQRPLVSIKVGGQIKEALLDTGADDTVLEDINLPGKWKPK
MIGGIGGFIKVRQYDQIPIEICGKKAIGTVLVGPTPVNIIGRNMLTQLGCTLNFPISPIE
TIPVKLKPGMDGPKVKQWPLTEEKIKALTEICKEMEKEGKIEKIGPENPYNTPVFAIKKK
DSTKWRKLVDFRELNKRTQDFWEVQLGIPHPSGLKKKKSVTVLDVEDAYFSVPLDENFRK
YTAFTIPSVNNETPGIRYQYNVLPQGWKGSPAIFQCSMTKILEPFRTQNPEIVIYQYMDD
LYVGSDLEIGQHRAKIEKLREHLLKWGFTTPDKKHQKEPPFLWMGYELHPDKWTVQPIKL
PEKDSWTVNDIQRLVGKLNWASQIYAGIKVRQLCKLLRGAKALTDIVPLTKEAELELAEN
REILKEPVHGVYYDPSKELIAEIQKQGQDQWTYQIYQEPFKNLKTGKYAKRRTAHTNDVK
QLAEAVQKITMESIVIWGRTPKFRLPIQKETWEAWWTDYWQATWIPEWEFVNTPPLVKLW
YQLEKEPIAEAETFYVDGAANRETKMGKAGYVTDKGRQKIVSLTETTNQKTELHAIQLAL
QDSGPEVNIVTDSQYALGIIQAQPDKSESELVSQIIEQLINKERIYLSWVPAHKGIGGNE
QVDKLVSKGIRKVLFLDGIDKAQEEHERYHSNWRAMANEFNLPPIVAREIVASCDKCQLK
GEAIHGQVDCSPGVWQLDCTHLEGKIILVAVHVASGYVEAEVIPAETGQETAYFLLKLAG
RWPVKTIHTDNGSNFTSAAVKAACWWAGVQQEFGIPYNPQSQGVVESMNKELKKIIGQIR
DQAEHLKTAVQMAVFIHNFKRKGGIGDYSAGERIIDIIATDIQTRELQKQIIQIQNFRVY
YRDSRDPVWKGPAKLLWKGEGAVVLQDNSDIKVVPRRKVKIIKDYGKQMAGADCVAGRQD
ENQ
>POL-C.syn4.2
FFRENLAFPEGEAREFPSEQTRANSPT-RANSPTSR-------KLQV--RGDNPRSEAGV
ER----QGT---LNFPQITLWQRPLVSIKIGGQTREALLDTGADDTVLEEIKLPGNWKPK
MIGGIGGFIKVRQYDQILIEICGKKAIGTVLIGPTPVNIIGRNLLTQLGCTLNFPISPIK
TVPVKLKPGMDGPKVKQWPLSEEKIKALTEICEEMEKEGKISKIGPENPYNTPVFAIKKK
DSTKWRKLVDFRELNKRTQDFWEIQLGIPHPAGLKKKKSVTVLDVGDAYFSVPLDEDFRK
YTAFTIPSINNATPGIRYQYNVLPQGWKGSPSIFQSSMTKILEPFRAKNPEIVIYQYMDD
LYVGSDLEIGQHRAKVEELREHLLKWGLTTPDKKHQKEPPFLWMGYELHPDKWTVQPIQL
PDKDSWTVNDIQKLVGKLNWASQIYPGIKVKQLCKLLRGTKALTDIVPLTAEAELELAEN
REILREPVHGVYYDPSKDLVAEIQKQGNDQWTYQIYQEPYKNLKTGKYAKMRSAHTNDVK
QLTEAVQKIALESIVIWGKAPKFRLPIQKETWEIWWTDYWQATWIPDWEFVNTPPLVKLW
YQLEKDPIAGVETFYVDGAANRETKLGKAGYVTDRGRQKIVSLSETTNQKTELQAIQLAL
QDSGLEVNIVTDSQYALGIIQAQPDKSESELVNQIIEELIKKEKVYLSWVPAHKGIGENE
QVDKLVSSGIRKVLFLDGIEKAQEEHEKYHNNWRAMASEFNLPPIVAKEIVASCDKCQLK
GEATHGQVDCSPGMWQLDCTHLEGKIIIVAVHVASGYLEAEVIPAETGQDTAYYILKLAG
RWPVKVIHTDNGTNFTSAAVKAACWWAGIQQEFGIPYNPQSQGVVESMNKELKKIIGQVR
EQAEHLKTAVLMAVFIHNFKRKGGIGEYSAGERIIDMIATDIQTKELQNQITKIQNFRVY
YRDSRDPIWKGPAKLLWKGEGAVVIQDNGDIKVVPRRKVKIIRDYGKQMAGDDCVAGRQD
EDQ
>POL-C.syn4.3
FFRENLAFPQGEAREFPPEQTRANSPTSRTNSPTSR-------ELQV--RGDNPHSEAGA
ERQGTLQGT---LNCPQITLWQRPLVSIRVGGQIKEALLDTGADDTVLEEISLPGKWKPK
MIGGIGGFIKVRQYDQIVIEICGKKAIGSVLVGPTPVNIIRRNMLTQLRCTLNFPISSIE
TVPVKLKPGMDGPRVKQWPLTEEKIKALTAICEEMEKEGKITKIGPDNPYNTPVFAIKKK
```

Fig. 10 cont'd-20

```
DSTKWRKLVDFKELNKRTQDFWEVQLGIPHPAGLKRKKSVTVLDVGDAYFSVPLDEGFRK
YTAFTIPSTNNETPGIRYQYNVLPQGWKGSPAIFQSSMIKILEPFRAQNPDIVIYQYMDD
LYIGSDLEIGQHRAKIEELRAHLLKWGFTTPDKKHQKEPPFLWMGCELHPDKWTVQPIQL
PEKESWTVNDIQRLVGKLNWASQIYSGIKVRQLCKLLRGVKALTDIVPLTEEAELELAEN
REILKETVHGAYYDPSKDLIAEIQKQGHDQWTYQIYQEPFKNLKTGKYAKMRTAHTNDIK
QLTEAVQKIAMESIVIWGKTPKFRLPIQKETWETWWTDYWQATWIPEWEFINTPPLVKLW
YQLEKEPIVGAETFYVDGAANRDTKLGKAGYITDRGRQKVVTLTETTNQKAELQAIQLAL
QDSGSKVNIVTDSQYALGIIQAQPDRSESELVNQIIEQLIKKERVYLSWVPAHKGIGGNE
QIDKLVSSGIRRVLFLDGIDKAQEDHEKYHSNWRAMASDFNLPPIVAKEIIASCDKCQLK
GEAMHGQVDCSPGIWQLDCTHLEGKVIIVAVHVASGYIEAEVIPAETGQETAYYILKLAG
RWPVKIIHTDNGSNFTSNAVKAACWWAGIHQEFGIPYNPQSQGVVEAMNKELKKIIGQVR
DQAEHLKTAVLMAVFIHNFKRRGGIGGYSAGERIIDIIASDIQTKELQKQITKIQNFRVY
YRDSRDPIWKGPAKLLWKGEGAVVIQDNSDIKVIPRRKAKIIKDYGKQMAGADCVAGGQD
EN-
>POL-C.syn4.4
FFRENLAFQQGEAREFPSEQTRAISPTSR--------------ELQV--RGDNPCSEAGA
ER----QGT---FNFPQITLWQRPLVTIKVGGQVKEALLDTGADDTVLEEINLPGKWKPR
MIGGIGGFIKVRQYEQILIEICGKRAIGTVLVGPTPINIIGRNMLTQIGCTLNFPISPIE
TVPVKLKPGMDGPKIKQWPLTEEKIKALTAICDEMEKEGKITKIGPENPYNTPIFAIKKK
DSTKWRKLVDFRELNKRTQDFWEVQLGIPHPAGLKKKRSVTVLDVGDAYFSVPLDESFRK
YTAFTIPSINNETPGIRYQYNVLPQGWKGSPAIFQSSMTRILEPFRAQNPEIVIYQYMDD
LYVGSDLEIEQHRAKIEELREHLLRWGFTTPDKKHQKEPPFLWMGYELHPDKWTVQPIQL
PEKDSWTVNDIQKIVGKLNWASQIYPGIKVRQLCRLLRGAKALTDIIPLTEEAELELAEN
REILKEPVHGAYYDPSKDLIAEIQKQGDDQWTYQIYQESFKNLKTGKYAKMRTAHTNDVR
QLTEAVQKIAQESIVIWGKIPKFRLPIQKDTWETWWTDYWQATWIPDWEFVNTPPLVKLW
YQLEKEPIAGAETFYVDGAANRETKIGKAGYVTDRGRQKVITLTETTNQKTELQAIHLAL
QDSGSEVNIVTDSQYALRIIQAQPDKSESEIVNQIIEQLINKERVYLSWVPAHKGIGGNE
QVDKLVSNGIRKVLFLDGIDKAQEEHEKYHSNWRAMASEFNLPPVVAKEIVASCDKCQQK
GEAIHGQVDCSPRIWQLDCTHLEGKVILVAVHVASGYMEAEVIPAETGQETAYFILKLAG
RWPVKVIHTDNGSNFTSTAVKAACWWAGIKQEFGIPYNPQSQGVVESMNKELKKIIEQVR
DQAEHLKTAVQMAVLIHNFKRKGGIGGYSAGERIVDIIATDIQTKELQKQIIKIQNFRVY
YRDNRDPIWKGPAKLLWKGEGAVVIQDNSEIKVVPRRKAKIIRDYGKQMAGADCVASRQD
ED-
>POL-C.syn6.1
FFRENLAFPQGKAREFPSEQTRAISPTSR--------------ELQV--RGNNPRSEAGA
ER----QGT---LNLPQITLWQRPLVSIKIGGQTREALLDTGADDTVLEEIKLPGNWKPK
MIGGIGGFIKVRQYDQILIEICGKRAIGTVLVGPTPVNIIGRNMLTQIGCTLNFPISSIE
TVPVKLKPGMDGPKVKQWPLTEEKIKALTEICEEMEKEGKITKIGPDNPYNTPVFAIKKK
DSTKWRKLVDFKELNKRTQDFWEVQLGIPHPAGLKKNKSVTVLDVGDAYFSVPLDESFRK
YTAFTIPSINNETPGIRYQYNVLPQGWKGSPAIFQSSMTRILEPFRAQNPDIVIYQYMDD
LYVGSDLEIEQHRAKIEELREHLLRWGFTTPDKKHQKEPPFLWMGCELHPDKWTVQPIQL
PEKDSWTVNDIQKLVGKLNWASQIYSGIKVRQLCKLLRGVKALTDIVPLTKEAELELAEN
REILREPVHGVYYDPAKDLIAEIQKQGQDQWTYQIYQEPFKNLKTGKYAKRRTAHTNDVK
QLTEAVQKIATESIVIWGKIPKFRLPIQKDTWETWWTDYWQATWIPDWEFVNTPPLVKLW
YQLEKEPIAEAETFYVDGAASRETKMGKAGYVTDRGRQKVITLTETTNQKTELQAIKLAL
QDSGSEVNVVTDSQYALGIIQAQPDKSESEIVNQIIEQLINKERVYLSWVPAHKGIGGNE
QVDKLVSRGIRKVLFLDGIDKAQDEHEKYHSNWRAMASEFNLPPIVAREIVASCDKCQLK
GEATHGQVDCSPGIWQLDCTHLEGKIILVAVHVASGYIEAEVIPTETGQETAYYILKLAG
RWPVKIIHTDNGSNFTSSAVKAACWWAGIQQEFGIPYNPQSQGVVESMNKELKKIIGQVG
DQAEHLKTAVQMAVFIHNFKRRGGIGGYSAGERIIDIIATDIQTRELQKQIIKIQNFQVY
YRDSRDPIWKGPAKLLWKGEGAVVIQDNSEIKVVPRRKVKIIKDYGKQMAGADCMASRQD
ED-
>POL-C.syn6.2
FFRENLAFPQGEARELPSEQTRANGPTSR--------------ELQV--RGDNPCSEAGA
ER----QGT---FNFPQITLWQRPLVTIKVGGQVKEALLDTGADDTVLEEINLPGKWKPK
```

Fig. 10 cont'd-21

```
MIGGIGGFIKVRQYDQIPIEICGKRAIGTVLVGPTPINIIGRNMLTQLGCTLNFPISPIE
TVPVQLKPGMDGPRVKQWPLTEEKIKALTEICKEMEKEGKISKIGPENPYNTPIFAIKKK
DSTKWRKLVDFRELNKRTQDFWEVQLGIPHPAGLKKKRSVTVLDVGDAYFSVPLDEDFRK
YTAFTIPSINNETPGVRYQYNVLPQGWKGSPSIFQSSMTKILEPFRTQNPEIVIYQYMDD
LYIGSDLEIGQHREKIEELREHLLKWGFTTPDKKHQKEPPFLWMGYELHPDKWTVQPIKL
PEKDSWTVNDIQRLVGKLNWASQIYAGIKVRQLCKLLGAKALTDIVTLTEEAELELAEN
REILKEPVYGVYYDPSKDLVAEIQKQGNDQWTYQIYQESFKNLKTGKYAKMRTAHTNDIK
QLTEAVQKIAQESIVIWGKTPKFRLPIQKETWEAWWTDYWQATWIPDWEFVNTPPLVKLW
YQLEKEPMAGVETFYVDGAANRETKIGKAGYVTDRGRQKVVTITETTNQKTELQAIYLAL
QDSGSKVNIVTDSQYALGIIQAQPDKSESELVSQIIEQLINKEKIYLSWVPAHKGIGGNE
QVDKLVSSGIRKVLFLDGIDKAQEDHERYHSNWRAMASDFNLPPIVAKEIVASCDQCQLK
GEAMHGQVDCSPGMWQLDCTHLEGKIIIVAVHVASGYIEAEVISAETGQETAYYILKLAG
RWPVKVVHTDNGSNFTSAAVKAACWWAGVQQEFGIPYNPQSQGVVESMNKELKRIIGQVR
DQAEHLKTAVQMAVFIHNFKRKGGIGGYSAGERIIDMIATDIQTKELQKQIIQIQNFRVY
YRDSRDPIWKGPAKLLWKGEGAVVIQDKGDIKVVPRRKAKIIRDYGKQMAGADCMAGRQD
EDQ
>POL-C.syn6.3
FFREDLAFPQGEARKFPPEQTRANSPTSRANSPTSR------KLQV--RGDNPRSEAGV
ER----QGT---LNFPQITLWQRPLVSIKVGGQIREALLDTGADDTVLEEMSLPGKWKPK
MIGGIGGFIKVKQYEQILIEICGKKAIGSVLVGPTPVNIIGRNLLTQLGCTLNFPISPIE
TVPVKLKPGMDGPKVQWPLTEEKIKALTAICDEMEKEGKITKIGPENPYNTPVFAIKKK
DSTKWRKLVDFKELNKRTQDFWEVQLGIPHPAGLKKKKSVTVLDVGDAYFSVPLDENFRK
YTAFTIPSRNNETPGIRYQYNVLPQGWKGSPAIFQASMTKILEPFRAKNPEIVIYQYMDD
LYVGSDLEIGQHRAKIEELRDHLLKWGFTTPDKKHQKEPPFLWMGYELHPDKWTVQPIEL
PEKDSWTVNDIQKLVGKLNWASQIYPGIQVKQLCKLLRGAKALTDVVPLTEEAELELAEN
REILKEPVHGAYYDPSKDLIAEIQKQGHDQWTYQIYQEPYKNLKTGKYAKRRAAHTNDVK
QLTEAVQKIAMESIVIWGKTPKFRLPIQKETWETWWTEYWQATWIPEWEFVNTPPLVKLW
YQLEKEPIAGAETFYVDGAANRETKMGKAGYITDRGRQKIISLTETTNQKTELHAIQLAL
QDSGSEANIVTDSQYALGIIQAQPDRSESELVNQIIEQLIKKERVYLAWVPAHKGIGENE
QVDKLVSSGIRKILFLDGIDKAQEEHEKYHSNWKAMASEFNLPPVVAREIVASCDKCQLK
GEAMHGQVDCSPRIWQLDCTHLERKVILVAVHVASGYMEAEVIPAETGQETAYFILKLAG
RWPVKVIHTDNGSNFTSNAVKAACWWAGIHQEFGIPYNPQSQGVVESMNKELKKIIEQVR
DQAEHLKTAVQMAVLIHNFKRKGGIGGYTAGERIIDIIATDIQTKELQNQITKIQNFRVY
YRDNRDPIWKGPAKLLWKGEGAVVLQDNSDIKVVPRRKVKIIRDYGKQMAGADCVAGRQD
ED-
>POL-C.syn6.4
FFRKNLAFPQGEAREFPPEQTRANSPTSR-------------ELQV--RGDNPLSEAGA
ERQGTLQGT---LNCPQITLWQRPLVSIKVGGQIKEALLDTGADDTVLEEISLPGKWKPK
MIGGIGGFIKVRQYDQIVIEICGKKAIGAVLVGPTPVNIIRRNMLTQLRCTLNFPISPIK
TVPVKLKPGMDGPKVQWPLSEEKIKALTAICEDMEKEGKITKIGPENPYNTPIFAIKKK
DSTKWRKLVDFRELNKRTQDFWEVQLGIPHPSGLKKKKSVTVLDVEDAYFSVPLDEGFRK
YTAFTIPSINNATPGIRYQYNVLPQGWKGSPAIFQSSMTKILEPFRTKNPDIVIYQYMDD
LYVGSDLEIGQHRAKIEKLREHLLRWGLTTPDKKHQKEPPFLWMGYELHPDKWTVQPIQL
PDKDSWTVNDIQKLVGKLNWASQIYAGIKVQLCRLLRGAKALTDIIPLTEEAELELAEN
REILKEPVHGAYYDPSKDLIAEIQKQGQGQWTYQIYQEPYKNLKTGKYAKMRTAHTNDVK
QLAEAVQKITMESIVIWGRTPKFRLPIQKETWETWWTDYWQATWIPEWEFINTPPLVKLW
YQLEKEPIVGAETFYVDGAANRETKLGKAGYVTDKGRQKIVSLTETTNQKTELQAIHLAL
QDSGSEVNIVTDSQYALRIIQAQPDKSESELVNQIIEQLINKERIYLSWVPAHKGIGGNE
QVDKLVSNGIRKVLFLDGIEKAQEEHERYHSNWRAMANEFNLPPIVAREIVASCDKCQIK
GEAMHGQVDCSPGVWQLDCTHLEGKVILVAVHVASGYVEAEVIPAETGQEAAYFILKLAG
RWPVKTIHTDNGSNFTSTAVKAACWWAGIKQEFGIPYNPQSQGVVESMNKELKKIIGQVR
DQAEHLKTAVQMAVLIHNFKRKGGIGDYSAGERIIDIIATDMQTKELQKQIIKVQNFRVY
YRDSRDPIWKGPAKLLWKGEGAVVIQDNGDIKVVPRRKVKIIKDYGRQMAGADCVASRQD
ED-
```

Fig. 10 cont'd-22

>POL-C.syn6.5
FFRENLAFPEGEAREFPSEQARANSPTSR--------------ELQV--RRDNPRSEAGA
EG----QGT---LNFPQITLWQRPLVSIRVGGQIKEALLDTGADDTVLEEINLPGRWKPK
MIGGIGGFIKVRQYDQITIEICGKKAIGTVLVGPTPINIIGRNMLTQIGCTLNFPISPIE
TVPVKLKPGMDGPKIKQWPLTEEKIKALKAICEEMEKEGKIEKIGPENPYNTPVFAIKKK
DSTKWRKLVDFRELNKRTQDFWEIQLGIPHPAGLKRKKSVTVLDVGDAYFSVPLYEDFRK
YTAFTIPSVNNETPGIRYQYNVLPQGWKGSPAIFQCSMTKILEPFRAQNPEIVIYQYMDD
LYVGSDLEIGQHRAKVEELREHLLKWGLTTPDKKHQKEPPFLWMGYELHPDKWTVQPIQL
PEKESWTVNDIQKIVGKLNWASQIYPGIKVRQLCRLLRGAKALTDIVPLTAEAELELAEN
REILKEPVHGVYYDPSKELIAEIQKQGDDQWTYQIYQEPFKNLKTGKYAKMRSAHTNDVK
QLTEAVQKIALESIVIWGKAPKFRLPIQKETWEIWWTDYWQATWIPEWEFINTPPLVKLW
YQLEKEPIAGVETFYVDGAANRDTKIGKAGYVTDRGRQKIVSLSETTNQKTELQAIQLAL
QDSGLEVNIVTDSQYALGIIQAQPDNSESELVNQIIEELIKKERVYLSWVPAHKGIGGNE
QVDKLVSKGIRKVLFLDGIDKAQEEHEKYHNNWRAMASDFNLPPVVAKEIVACCDKCQLK
GEAIHGQVDCSPGIWQLDCTHLEGKVIIVAVHVASGYLEAEVIPAETGQETAYFLLKLAG
RWPVKVIHTDNGPNFTSAAVKAACWWAGINQEFGIPYNPQSQGVVESMNKELKKIIGQVR
EQAEHLKTAVQMAVFIHNFKRKGGIGGYSAGERIVDIIATDIQTKELQNQIIKIQNFRVY
YRDSRDPIWKGPAKLLWKGEGAVVIQENSDIKVVPRRKAKIIKDYGKQMAGDDCVAGRQD
EDQ
>POL-C.syn6.6
FFRENLAFQQGEAREFPSEQTRANSPT-RANSPTSRTNSPTSRELQV--RGDNPHSEAGA
ER----QGS---LNFPQITLWQRPLVTIKIGGQLKEALLDTGADDTVLEDINLPGKWKPR
MIGGIGGFIKVRQYEQIPIEICGKKAIGTVLIGPTPVNIIGRNLLTQLGCTLNFPISPIE
TIPVKLKPGMDGPKVKQWPLTEEKIKALTAICEEMEKEGKITKIGPDNPYNTPVFAIKKK
DSTKWRKLVDFRELNKRTQDFWEVQLGIPHPAGLKKKKSVTVLDVGDAYFSVPLDKDFRK
YTAFTIPSTNNETPGIRYQYNVLPQGWKGSPAIFQSSMIKILEPFRAKNPELVIYQYMDD
LYVGSDLEIMQHRAKIEELRAHLLKWGFTTPDKKHQKEPPFLWMGYELHPDKWTVQPIVL
PEKDSWTVNDIQKLVGKLNWASQIYPGIKVKQLCKLLRGTKALTDIVPLTEEAELELAEN
REILKETVHGAYYDPSKDLIAEIQKQGYDQWTYQIYQEPFKNLKTGKYAKKRTAHTNDVR
QLTEAVQKIAIESIVIWGKTPKFRLPIQKETWETWWADYWQATWIPEWEFVNTPPLVKLW
YQLEKDPIAGAETFYVDGAANRETKKGKAGYVTDKGRQKVVTLTETTNQKAELQAIQLAL
QDSGPEVNIVTDSQYALRIIQAPPDKSESGLVNQIIEQLIKKEKVYLSWVPAHKGIGGNE
QIDKLVSSGIRRVLFLDGIDKAQEDHEKYHSNWRAMAGEFNLPPVVAKEIVASCDKCQQK
GEAIHGQVDCSPGIWQLDCTHLEGKIILVAVHVASGYIEAEVIPAETGQDTAYYILKLAG
RWPVKVIHTDNGTNFTSAAVKAACWWASIQQEFGIPYNPQSQGVVEAMNKELKKIIGQIR
DQAEHLKTAVLMAVFIHNFKRKGGIGEYSAGERIIDIIASDIQTKELQKQITKIQNFRVY
YRDSRDPWWKGPAKLLWKGEGAVVIQDNSDIKVIPRRKAKIIRDYGKQMAGADCVAGGQD
ED-
>POL-M.syn1.1
FFRENLAFPQGEAREFPSEQTRANSPTSRANSPTSR-------ELQV--RGDNPRSEAGA
ER----QGT---LNFPQITLWQRPLVTIKIGGQLKEALLDTGADDTVLEDINLPGKWKPK
MIGGIGGFIKVRQYDQILIEICGKKAIGTVLVGPTPVNIIGRNMLTQIGCTLNFPISPIE
TVPVKLKPGMDGPKVKQWPLTEEKIKALTEICTEMEKEGKISKIGPENPYNTPVFAIKKK
DSTKWRKLVDFRELNKRTQDFWEVQLGIPHPAGLKKKKSVTVLDVGDAYFSVPLDESFRK
YTAFTIPSINNETPGIRYQYNVLPQGWKGSPAIFQSSMTKILEPFRKQNPDIVIYQYMDD
LYVGSDLEIGQHRAKIEELREHLLKWGFTTPDKKHQKEPPFLWMGYELHPDKWTVQPIQL
PEKDSWTVNDIQKLVGKLNWASQIYPGIKVKQLCKLLRGAKALTDIVPLTEEAELELAEN
REILKEPVHGVYYDPSKDLIAEIQKQGQDQWTYQIYQEPFKNLKTGKYAKMRTAHTNDVK
QLTEAVQKIATESIVIWGKTPKFRLPIQKETWETWWTDYWQATWIPEWEFVNTPPLVKLW
YQLEKEPIVGAETFYVDGAANRETKLGKAGYVTDRGRQKVVSLTETTNQKTELQAIQLAL
QDSGSEVNIVTDSQYALGIIQAQPDKSESELVNQIIEQLIKKEKVYLSWVPAHKGIGGNE
QVDKLVSSGIRKVLFLDGIDKAQEEHEKYHSNWRAMASDFNLPPIVAKEIVASCDKCQLK
GEAMHGQVDCSPGIWQLDCTHLEGKVILVAVHVASGYIEAEVIPAETGQETAYFILKLAG
RWPVKVIHTDNGSNFTSAAVKAACWWAGIQQEFGIPYNPQSQGVVESMNKELKKIIGQVR
DQAEHLKTAVQMAVFIHNFKRKGGIGGYSAGERIIDIIATDIQTKELQKQITKIQNFRVY

Fig. 10 cont'd-23

```
YRDSRDPIWKGPAKLLWKGEGAVVIQDNSDIKVVPRRKAKIIRDYGKQMAGDDCVAGRQD
EDQ

>POL-M.syn3.1
FFRENLAFPQGEAREFPSEQTRANSPTSRANSPTSR-------ELQV--RGDNPRSEAGA
ER----QGT---LNFPQITLWQRPLVSIKVGGQIKEALLDTGADDTVLEEINLPGKWKPK
MIGGIGGFIKVRQYDQIPIEICGKRAIGTVLVGPTPINIIGRNMLTQLGCTLNFPISPIK
TVPVKLKPGMDGPKVKQWPLTEEKIKALTAICEEMEKEGKITKIGPENPYNTPVFAIKKK
DGTKWRKLVDFRELNKRTQDFWEVQLGIPHPSGLKKKKSVSVLDVGDAYFSVPLDESFRK
YTAFTIPSINNETPGIRYCYNVLPQGWKGSPAIFQCSMTKILEPFRAQNPEIVIYQYMDD
LYIGSDLEIGQHRAKIEELREHLLRWGFTTPDKKHQKEPPFLWMGCELHPDKWTVQPIQL
PEKDSWTVNDIQKIVGKLNWASQIYPGIKVRQLCKLLRGAKALTDIVPLTEEAELELAEN
REILREPVHGVYYDPSKDLVAEIQKQGQDQWTYQIYQEPFKNLKTGKYAKMRTAHTNDVK
QLTEAVQKIALESIVIWGKIPKFRLPIQKETWEAWWMEYWQATWIPEWEFINTPPLVKLW
YQLEKEPIAGAETFYVDGAANRETKIGKAGYVTDRGRQKIVSLTETTNQKAELQAIQLAL
QDSGPEVNIVTDSQYALGIIQAHPDKSESELVNQIIEQLIKKERVYLSWVPAHKGIGENE
QVDKLVSNGIRKILFLDGIDKAQEEHEKYHSNWRAMASEFNLPPIVAKEIVASCNKCQLK
GEALHGQVDCSPGMWQLDCTHLEGKVILVAVHVASGYMEAEVIPAETGQETAYYILKLAG
RWPVKVVHTDNGSNFTSTAVKAACWWAGIQQEFGIPYNPQSQGVIESMNKELKKIIGQIR
DQAEHLKTAVQMAVFIHNFKRKGGIGEYSAGERIIDIIATDIQTRELQKQIIKIQNFRVY
YRDSRDPIWKGPAKLLWKGEGAVVLQDNSDIKVVPRRKVKIIKDYGKQMAGADCVAGRQD
ENQ >POL-M.syn3.2
FFRENLAFQQGEARKFSSEQTGANSPTSR--------------ELRV-RRGDNPLSEAGA
ER----RGTVPSLSFPQITLWQRPLVTVKIGGQLIEALLDTGADDTVLEDINLPGKWKPR
MIGGIGGFIKVKQYDQILIEICGKKAIGTVLVGPTPVNIIGRNMLTQIGCTLNFPISPID
TVPVTLKPGMDGPKIKQWPLTEEKIKALTEICTEMEKEGKISRIGPENPYNTPIFAIKKK
DSTKWRKLVDFRELNKKTQDFWEVQLGIPHPAGLKKKRSVTVLDVGDAYFSVPLDKDFRK
YTAFTIPSTNNETPGIRYQYNVLPQGWKGSPSIFQSSMTRILEPFRAKNPEIVIYQYMDD
LYVGSDLEIEQHRTKIEELRQHLLRWGLTTPDKKHQKEPPFLWMGYELHPDRWTVQPIEL
PEKESWTVNDIQKLVGKLNWASQIYAGIKVKQLCKLLRGTKALTEVVPLTEEAELELEEN
REILKDPVHGAYYDPSKDLIAEIQKQGHDQWTYQIYQEQYKNLKTGKYARKRSAHTNDVR
QLTEAVQKIATESIVIWGKTPKFRLPIQRETWETWWTDYWQATWIPEWEFVNTPPLVKLW
YQLEKDPIAGVETFYVDGASNRETKKGKAGYVTDKGRQKVVSLTETTNQKTELHAIHLAL
QDSGSEVNIVTDSQYALGIIQAQPDRSESELVNQIIEELIKKEKVYLSWVPAHKGIGGNE
QVDKLVSSGIRKVLFLDRIDKAQEEHERYHSNWRTMASDFNLPPIVAKEIVANCDKCQLK
GEAMHGQVDCSPGIWQIDCTHLEGKVIIVAVHVASGYIEAEVIPAETGQETAYFLLKLAG
RWPVKVIHTDNGSNFTSAAVKAACWWANVTQEFGIPYNPQSQGVVESMNKELKKIIGQVR
EQAEHLKTAVQMAVLIHNFKRKGGIGGYSAGERIIDIIASDIQTKELQKQIIKVQNFRVY
YRDSRDPVWKGPAKLLWKGEGAVVIQDNSDIKVVPRRKVKIIRDYGKQMAGDDCVAGRQD
EDQ >POL-M.syn3.3
FFREDLAFPQGKAREFSSEQTRANSPTRR--------------ELQVWGRDNNSLSEAGA
DR----QGTVS-FSFPQITLWQRPLVTIKIGGQLKEALLDTGADDTVLEEMNLPGRWKPK
MIGGIGGFIKVRQYDQILIEICGHKAIGTVLIGPTPVNIIGRNLLTQIGCTLNFPISPIE
TVPVKLKPGMDGPRVKQWPLTEEKIKALVEICTEMEKEGKISKIGPENPYNTPVFAIKKK
DSTRWRKLVDFRELNKRTQDFWEIQLGIPHPAGLKKKKSVTVLDVGDAYFSVPLDEGFRK
YTAFTIPSVNNETPGVRYQYNVLPQGWKGSPAIFQSSMTKILEPFRKQNPDIVIYQYMDD
LYVGSDLEIGQHRTKIEELREHLLKWGFTTPDKKHQNEPPFLWMGYELHPDKWTVQPIVL
PEKDSWTVNDLQKLVGKLNWASQIYPGIKVKQLCRLLRGAKALTEVIPLTKEAELELAEN
REILKEPVHGVYYDPSKELIAEIQKQGQGQWTYQIYQEPYKNLKTGKYARMRGAHTNDVK
QLTEVVQKIAMESIVIWGKTPKFKLPIQKETWETWWTEYWQATWIPDWEFVNTPPLVKLW
YQLEKEPIVGAETFYVDGAANRETKLGKAGYVTDRGRQKVVSLTDTTNQKTELQAIHLAL
QDSGLEVNIVTDSQYAIGIIQAQPDKSESELVSQIIEQLIKKEKVYLAWVPAHKGIGGNE
QVDKLVSAGIRKVLFLDGIDKAQEDHEKYHNNWRAMASDFNLPPVVAKEIVASCDKCQLK
```

Fig. 10 cont'd-24

```
GEAIHGQVDCSPGIWQLDCTHLEGKIILVAVHVASGYLEAEVIPAETGQETAYFILKLAG
RWPVKTIHTDNGSNFTSTTVKAACWWAGIKQEFGIPYNPQSQGVVESINKELKKIIGQVR
DQAEHLKTAVLMAVFIHNFKRRGGIGGYSAGERIVDIIATDIQTKELQKQITKIQNFRVY
YRDSRDPLWKGPAKLLWKGEGAVVIQDNSEIKVVPRRKAKIIRDYGKQMAGDDCVASRQD
ED-
>POL-M.syn4.1
FFRENLAFQQGEARKFSSEQTRANSPTRG--------------ELQVWGRDNNPLSEAGA
ER----RGTVPSLSFPQITLWQRPLVTVKIGGQLIEALLDTGADDTVLEDINLPGKWKPK
MIGGIGGFIKVKQYDQILIEICGKKAIGTVLVGPTPVNIIGRNMLTQIGCTLNFPISPID
TVPVTLKPGMDGPRIKQWPLTEEKIKALTEICKEMEEEGKISKIGPENPYNTPIFAIKKK
NSTRWRKLVDFRELNKKTQDFWEVQLGIPHPAGLKRKKSVTVLDVEDAYFSVPLDESFRK
YTAFTIPSINNETPGVRYQYNVLPQGWKGSPAIFQCSMTKILEPFRIKNPEMVIYQYMDD
LYVGSDLEIGQHRIKIEELRAHLLSWGFTTPDKKHQKDPPFLWMGYELHPDRWTVQPIEL
PEKDSWTVNDIQKLVEKLNWASQIYSGIKVRQLCRLLRGAKALTDIVPLTEEAELELAEN
REILKEPVHGAYYDPSKDLVAEIQKQGQDQWTYQIYQEPFKNLKTGKYARKRSAHTNDVK
QLTEVVQKIATESIVIWGKTPKFRLPIQRETWETWWTEYWQATWIPEWEFVNTPPLVKLW
YQLEKDPIAGVETFYVDGAASRETKLGKAGYVTDRGRQKVVSLTETTNQKTELHAIHLAL
QDSGSEVNIVTDSQYVLGIIQAQPDRSESELVNQIIEELIKKEKVYLSWVPAHKGIGGNE
QVDKLVSSGIRKVLFLNGIDKAQEEHERYHSNWRTMASDFNLPPIVAKEIVANCDKCQLK
GEAMHGQVDCSPGVWQLDCTHLEGKVIIVAVHVASGYIEAEVIPAETGQEAAYFILKLAG
RWPVKVVHTDNGSNFTSAAVKAACWWANVRQEFGIPYNPQSQGVVESMNNELKKIIGQIR
DQAEHLKTAVLMAVFIHNFKRKGGIGEYSAGERIIDIIATDIQTRELQKQITKIQNFRVY
FRDSRDPIWKGPAKLLWKGEGAVVIQDNSEIKVVPRRKVKIIRDYGKQMAGDDCVAGRQD
EN-
>POL-M.syn4.2
FFRENLAFPQGEAREFPSEQARANSPTSRANSPTSR-------DLWDGGRDNLP-SEAGA
ER----QGT---LNFPQITLWQRPLVTVRIGGQLREALLDTGADDTVLEDIDLPGKWKPK
IIGGIGGFIKVRQYEQIPIEICGHKAIGTVLVGPTPINIIGRNMLTQLGCTLNFPISPIK
TVPVKLKPGMDGPRVKQWPLTEEKIKALTAICEEMEKEGKITKIGPENPYNTPVFAIKKK
DSTRWRKLVDFRELNRRTQDFWEVQLGIPHPAGLKKKRSVTVLDVGDAYFSVPLDEGFRK
YTAFTIPSVNNETPGIRYQYNVLPQGWKGSPSIFQSSMTRILEPFRAKNPEIVIYQYIDD
LYVRSDLEIGQHRAKIEELREHLLRWGFTTPDKKHQKEPPFLWMGCELHPDKWTVQPIQL
PEKDSWTINDIQKLVGKLNWASQIYPGIKVRQLCKLLRGTKALTDIVTLTEEAELELAEN
REILKDPVHGVYYDPSKELIAEIQKQGDDQWTYQIYQEQYKNLKTGKYAKRRTAHTNDVR
QLTEAVQKIALESIVIWGKIPKFRLPIQKETWEAWWMEYWQATWIPEWEYVNTPPLVKLW
YQLEKEPIIGAETFYVDGAANRETKLGKAGYVTNRGRQKVVSLTDTTNQKTELQAIQLAL
QDSGSEVNVVTDSQYALGIIQAHPDKSESELVNQIIEQLIKKERVYLSWVPAHKGIGGNE
QVDKLVSAGIRKVLFLDGIDKAQEDHERYHSNWRAMASDFNLPPVVAKEIVASCNKCQLK
GEAIHGQVDCSPGIWQLDCTHLEGKIIIVAVHVASGYMEAEVIPAETGQETAYFILKLAG
RWPVKIIHTDNGSNFTSATVKAACWWANVTQEFGIPYNPQSQGVVESINKELKKIIGQVR
DQAEHLRTAVQMAVFIHNFKRRGGIGGYSAGERIVDIIATDIQTKELQKQITKIQKFRVY
YRDSRDPLWKGPAKLLWKGEGAVVIQDNSDIKVIPRRKAKIIKDYGKQMAGADCVAGRQD
EDQ
>POL-M.syn4.3
FFRENLAFPQGKAREFPSEQTRANSPTSRANSPTSR--------ELQV--RGDNPRSEAGA
ER----QGT---FNFPQITLWQRPLVSIKVGGQIKEALLDTGADDTVLEEINLPGKWKPR
MIGGIGGFIKVRQYDQILIEICGKRAIGTVLVGPTPANIIGRNLLTQLGCTLNFPISPIE
TVPVKLKPGMDGPKIKQWPLTEEKIKALTEICTEMEKEGKISKIGPENPYNTPIFAIKKK
DSTKWRKLVDFKELNKRTQDFWEVQLGIPHPSGLKKKKSVTVLDVGDAYFSVPLDEDFRK
YTAFTIPSTNNETPGIRYQYNVLPQGWKGSPAIFQASMTKILEPFRAQNPEIVIYQYMDD
LYVGSDLEIEQHRAKVEELREHLLKWGFTTPDKKHQNEPPFLWMGYELHPDKWTVQPIKL
PEKESWTVNDIQKLVGKLNWASQIYPGIKVKQLCRLLRGTKALTEVIPLTKEAELELAEN
REILREPVHGVYYDPTKDLIAEIQKQGHDQWTYQIYQEPHKNLKTGKYAKMRTAHTNDVK
QLAEAVQKIAMESIVIWGKIPKFKLPIQKETWETWWTDYWQATWIPDWEFVNTPPLVKLW
```

Fig. 10 cont'd-25

```
YQLEKEPIAGAETFYVDGAANRETKIGKAGYVTDRGRQKIVSLTETTNQKAELQAIQLAL
QDSGPEVNIVTDSQYALGIIQAQPDKSESEIVNQIIEKLIEKDKVYLSWVPAHKGIGGNE
QIDKLVSNGIRKVLFLDGIEKAQEEHEKYHSNWRAMASEFNLPPIVAKEIVASCDKCQLK
GEATHGQVDCSPGMWQLDCTHLEGKIILVAVHVASGYIEAEVIPTETGQETAYYILKLAG
RWPVKVIHTDNGSNFTSTAVKAACWWAGIQQEFGIPYNPQGQGVVESMNKELKKIIGQVR
EQAEHLKTAVQMAVLIHNFKRKGGIGGYSAGERIIDIIASDIQTKELQKQIIKVQNFRVY
YRDSRDPIWKGPAKLLWKGEGAVVLQDNSDIKVVPRRKVKIIKDYGKQMAGADCVASRQD
EN-
>POL-M.syn4.4
FFREDLAFPQGKAREFSSEQTRANSPTRR--------------ELQVWGRDNNSLSEAGA
DR----QGTVS-FSFPQITLWQRPLVTIKIGGQLKEALLDTGADDTVLEEMNLPGRWKPK
MIGGIGGFIKVRQYDQIPIEICGKKAIGTVLIGPTPVNIIGRNLLTQIGCTLNFPISPIE
TIPVKLKPGMDGPKVKQWPLTEEKIKALVEICTEMEKEGKISRIGPENPYNTPVFAIKKK
DGTKWRKLVDFRELNKRTQDFWEIQLGIPHPAGLKKKKSVSVLDVGDAYFSVPLDKDFRK
YTAFTIPSINNETPGIRYCYNVLPQGWKGSPAIFQSSMTKILEPFRKQNPDIVIYQYMDD
LYIGSDLEIGQHRTKIEELRQHLLRWGLTTPDKKHQNEPPFLWMGYELHPDKWTVQPIVL
PEKDSWTVNDLQKLVGKLNWASQIYAGIKVKQLCKLLRGAKALTEVVPLTEEAELELEEN
REILKEPVHGVYYDPSKDLIAEIQKQGQGQWTYQIYQEPYKNLKTGKYARMRGAHTNDVK
QLTEAVQKIAQECIVIWGKTPKFKLPIQKETWETWWMDYWQATWIPEWEFINTPPLVKLW
YQLEKEPIVGAETFYVDGASNRETKKGKAGYVTDKGRQKVVTLTETTNQKTELQAIHLAL
QDSGLEVNIVTDSQYAIGIIQAQPDKSESELVSQIIEQLIKKEKVYLAWVPAHKGIGGNE
QVDKLVSNGIRKILFLDGIDKAQEEHEKYHNNWRAMASDFNIPPVVAKEIVACCDKCQLK
GEALHGQVDCSPRIWQLDCTHLEGKVILVAVHVASGYLEAEVIPAETGQETAYFLLKLAG
RWPVKTIHTDNGSNFTSTTVKAACWWAGIKQEFGIPYNPQSQGVIESMNKELKKIIEQVR
DQAEHLKTAVQMAVFVHNFKRKGGIGDYSAGERIIDIISTDIQTRELQKQIIKIQNFRVY
YRDSRDPVWKGPAKLLWKGEGAVVIQDNNEIKVVPRRKAKIIRDYGKQMAGDDCVASRQD
ED-
>POL-M.syn6.1
FFREDLAFPQGEARKFPSEQTRANSPTRG--------------ELQVWGRDNNSLSEAGD
DR----QGTVS-FNLPQITLWQRPLVTVRIGGQLIEALLDTGADDTVLEDMNLPGKWKPK
MIGGIGGFIKVRQYEQIPIEICGHKAIGTVLIGPTPVNIIGRNLLTQIGCTLNFPISPID
TVPVTLKPGMDGPKIKQWPLTEEKIKALTEICTEMEKEGKISRIGPENPYNTPVFAIKKK
NSTRWRKLVDFRELNKRTQDFCEVQLGIPHPAGLKKKRSVTVLDVGDAYFSVPLDENFRK
YTAFTIPSINNETPGVRYQYNVLPQGWKGSPAIFQASMTKILEPFRTKNPELVIYQYMDD
LYVGSDLEIEQHRTKIEELRAHLLSWGFTTPDKKHQKEPPFLWMGYELHPDKWTVQPIEL
PEKDSWTVNDIQKIVGKLNWASQIYPGIKVRQLCRLLRGTKALTDIVPLTAEAELELAEN
REILREPVHGVYYDPSKELIAEIQKQGHDQWTYQIYQDPFKNLKTGKYARKRSAHTNDVR
QLTEAVQKITTESIVIWGKTPKFRLPIQRETWEAWWMEYWQATWIPEWEFINTPPLVKLW
YQLEKDPIVGAETFYVDGAASRETKLGKAGYVTNKGRQKVVSLNETTNQKTELHAIHLAL
QDSGSEANIVTDSQYALGIIQAQPDRSESEVVNQIIEELIKKEKVYLSWVPAHKGIGGNE
QVDKLVSSGIRKVLFLDGIDKAQEDHERYHSNWRTMASDFNLPPIVAREIVASCDKCQQK
GEAMHGQVDCGPGIWQLDCTHLERKVILVAVHVASGYIEAEVIPAETGQETAYFVLKLAG
RWPVKVIHTDNGSNFTSAAVKAACWWANVTQEFGIPYNPQSQGVVESMNNELKKIIGQVR
EQAEHLKTAVLMAVFIHNFKRKRGIGGYSAGERIVDIIASDIQTKELQNQITKIQNFRVY
FRDSRDPIWKGPAKLLWKGEGAVVIQDNNDIKVVPRRKVKIIRDYGKQMAGDDCVAGRQD
EN-
>POL-M.syn6.2
FFREDLAFQQGEARKFSSEQTRANSPTSR--------------ELRVWG-GDNTLSETGA
ER----QGT---LNFPQITLWQRPLVTIKVGGQIKEALLDTGADDTVLEDINLPGKWKPR
MIGGIGGFIKVRQYDQIPIEICGKKAIGSVLVGPTPVNIIGRNMLTQLGCTLNFPISPIK
TVPVKLKPGMDGPKVKQWPLSEEKIKALTAICDEMEKEGKITKIGPDNPYNTPVFAIKKK
DGTKWRKLVDFKELNKRTQDFWEIQLGIPHPAGLKKKKSVSVLDVGDAYFSVPLDESFRK
YTAFTIPSLNNETPGIRYCYNVLPQGWKGSPAIFQSSMTKILEPFRAQNPEIVIYQYIDD
LYVRSDLEIGQHRAKIEELREHLLKWGLTTPDKKHQKEPPFLWMGYELHPDRWTVQPIQL
```

Fig. 10 cont'd-26

```
PDKDSWTVNDLQKLVGKLNWASQIYPGIRVKQLCKLLKGAKALTDIVTLTEEAELELAEN
REILKNPVHGVYYDPAKDLIAEIQKQGNDQWTYQIYQEPHKNLKTGKYAKMRTAHTNDVK
QLTEVVQKIAMESIVIWGKVPKFRLPIQKETWETWWTDYWQATWIPDWEFVNTPPLVKLW
YQLEKEPIAGAETFYVDGAANRETKMGKAGYVTDRGRQKVVSLTETTNQKTELQAIQLAL
QDSGPEVNIVTDSQYAIGIIQAQPDKSESEIVNQIIEQLIKKERVYLSWVPAHKGIGENE
QVDKLVSTGIRRVLFLDGIDKAQEEHERYHSNWRAMASEFNLPPIVAKEIVASCDQCQLK
GEAMHGQVDCSPGVWQLDCTHLEGKIILVAVHVASGYMEAEVIPAETGQETAYFILKLAA
RWPVKVIHTDNGPNFTSATVKAACWWANITQEFGIPYNPQGQGVVESMNKELKKIIKQVR
DQAEHLKTAVQMAVLIHNFKRKGGIGGYSAGERIIDIIASDIQTKELQKQIIKIQNFQVY
YRDSRDPIWKGPAKLLWKGEGAVVLQDNSDIKVVPRRKVKIIKDYGKQMAGADCVAGGQD
ED-
>POL-M.syn6.3
FFRENLAFPQGKAREFPSEQTRAISPTSR--------------ELQVWGGDNNSLSEAGA
ER----QGTVS-FSFPQITLWQRPIVTIKIGGQLREALLDTGADDTVLEEMNLPGRWKPK
MIGGIGGFIKVKQYDNILIEICGHKAVGTVLVGPTPANIIGRNLLTQLGCTLNFPISPIE
TVPVKLKPGIDGPKVKQWPLTEEKIKALVEICTEMEKEGKISKIGPENPYNTPIFAIKKK
DSTRWRKLVDFRELNRRTQDFWEVQLGIPHPAGLKRKKSVTVLDVGDAYFSVPLDKEFRK
YTAFTIPSINNETPGIRYQYNVLPQGWKGSPSIFQSSMTKILEPFRIKNPEMVIYQYMDD
LYIGSDLEIGQHRIKIEELREHLLKWGFTTPDKKHQKEPPFLWMGCELHPDKWTVQPIML
PEKDSWTVNDIQKLVGKLNWASQIYAGIKVRQLCKLLRGTKALTEVVPLTEEAELELAEN
REILKEPVHGAYYDPSKDLIAEVQKQGQDQWTYQIYQEPFKNLKTGKYAKKRSAHTNDVK
QLTEAVQKIALESIVIWGKAPKFRLPIQKETWEAWWTEYWQATWVPEWEFVNTPPLVKLW
YQLETEPIAGAETYYVDGAANRETKLGKAGYVTNRGRQKVVSLTDTTNQKTELQAIHLAL
QDSGLEVNIVTDSQYALGIIHAQPDKSESELVNQIIEQLINKERIYLSWVPAHKGIGENE
QVDKLVSKGIRKVLFLDGIEKAQEEHEKYHSNWKAMASEFNLPPVVAKEIVACCDKCQLK
GEALHGQVDCSPGMWQLDCTHLEGKIIIVAVHVASGYIEAEVIPTETGQETAYFLLKLAG
RWPVKTIHTDNGSNFTSTTVKAACWWAGIKQEFGIPYNPQSQGVVESINKELKKIIGQIR
DQAEHLKTAVLMAVFIHNFKRKGGIGGYTAGERIVDIIATDIQTKELQKQITKVQNFRVY
YRDSREPLWKGPAKLLWKGEGAVVIQDNNEIKVVPRRKAKILRDYGKQMAGADCVASRQD
EN-
>POL-M.syn6.4
FFRENLAFQQGEAREFSSEQTRTNSPTSR--------------ELWDGGRDNLP-SEAGA
ER----RGTVPSLSFPQITLWQRPLVTVKIGGQLKEALLDTGADDTVLEEINLPGKWKPK
LIGGIGGFIKVRQYDQILIEICGKKAIGTVLVGPTPINIIGRNMLTQIGCTLNFPISPIE
TIPVKLKPGMDGPRVKQWPLTEEKIKALIEICTEMEKEGKISRVGPENPYNTPIFAIKKK
NSNRWRKLVDFRELNKRTQDFWEVQLGIPHPGGLKKKKSVTILDVGDAYFSVPLDEDFRK
YTAFTIPSINNATPGIRYQYNVLPQGWKGSPAIFQCSMTKILEPFRKQNPEIIIYQYMDD
LYVRSDLEIGQHRTKIEELRQHLLKWGFYTPDKKHQKEPPFLWMGYELHPDKWTVQPIKL
PEKESWTVNDIQKLVEKLNWASQIYPGIKVKQLCRLLRGAKALTEVIPLTEEAELELEEN
REILKDPVHGVYYDPTKDLIAEIQKQGDDQWTYQIYQEPYKNLKTGKYAKRRTAHTNDVR
QLTEVVQKVATESIVIWGKIPKFKLPIQKETWEIWWTDYWQATWIPEWEFVNTPHLVKLW
YQLEKEPIIGAETFYVDGASNRETKKGKAGYVTDRGRQKIVSLTETTNQKAELQAIQLAL
QDSGSEVNIVTDSQYALGIIQAHPDKSESELVSQIIEQLIKKEKVYLAWVPAHKGIGGNE
QIDKLVSNGIRKILFLDGIDKAQEEHEKYHNNWRAMASDFNLPPVVAKEIVASCNKCQLK
GEAIHGQVDCSPRIWQLDCTHLEGKVIMVAVHVASGYVEAEVIPAETGQDTAYFILKLAG
RWPVKVVHTDNGSNFTSAAFKAACWWANVQQEFGIPYNPQSQGVVEAMNKELKKIIEQVR
DQAEHLKTAVQMAVFVHNFKRKGGIGDYSAGERIIDIIATDIQTRELQKQIIKIQNFRVY
YRDNRDPIWKGPAKLLWKGEGAVVIQDNSDIKVIPRRKAKIIRDYGKQMAGDDCMAGRQD
EDQ
>POL-M.syn6.5
FFREDLAFLQGKAREFSSEQTRANSPTRR--------------ELQVWGRDSNSLSEAGA
DR----QGTVS-FNFPQITLWQRPLVTIKIGGQLKEALLDTGADDTVLEDIDLPGKWKPK
IIGGIGGFIKVKQYDQILIEICGKRAIGTVLVGPTPVNIIGRNILTQIGCTLNFPISPID
TVPVKLKPGMDGPRIKQWPLTEEKIKALTEICKEMEEEGKISKIGPENPYNTPVFAIKKK
```

Fig. 10 cont'd-27

```
DSTKWRKVVDFRELNKGTQDFWEVQLGIPHPAGLKQKKSVTVLDVEDAYFSVPLDKDFRK
YTAFTIPSVNNETPGIRYQYNVLPQGWKGSPAIFQSSMTRILEPFRKQNPDIVIYQYMDD
LYVGSDLEIGQHRTKVEELRQHLLRWGFTTPDKKHQKDPPFLWMGYELHPDKWTVQPIVL
PEKDSWTINDIQKLVGKLNWASQIYSGIKVRQLCKCLRGTKALTEVIPLTKEAELELAEN
KEILKEPVHGVYYDPSKDLVAEIQKQGQGQWTYQIYQEQYKNLKTGKYARMRGAHTNDVK
QLAEAVQKIATESIVIWGKIPKFRLPIQRETWETWWTEYWQATWIPEWEYVNTPPLVKLW
YQLEKEPIVGAETFYVDGAANRDTKLGKAGYVTDRGRQKVVPLTDTTNQKTELQAINLAL
QDSGSKVNIVTDSQYVLGIIQAQPDRSESEIVNQIIEKLIEKDKVYLSWVPAHKGIGGNE
QVDKLVSAGIRKVLFLDGIDKAQDEHEKYHSNWRAMASDFNLPPVIAKEIVASCDKCQLK
GEATHGQVDCSPGIWQLDCTHLEGKVIIVAVHVASGYIEAEVISAETGQETAYYILKLAG
RWPVKIIHTDNGSNFTSTAVKAACWWAGIQQEFGIPYSPQSQGVVESMNKQLKQIIGQVR
DQAEQLKTAVQMAVFIHNFKRKGGIGEYSAGERIIDIISTDIQTRELQKQITKIQNFRVY
YRDSRDPVWKGPAKLLWKGEGAVVIQDNSEIKVVPRRKAKIIRHYGKQMAGDDCVASRQD
EDQ
>POL-M.syn6.6
FFRENLAFPQGEAREFPSEQARANSPTSRANSPTSR------ELQV--RGDNPRSEAGA
ERQGTLQGT---LNCPQITLWQRPLVSIKVGGQVKEALLDTGADDTVLEEMSLPGKWKPK
MVGGIGGFIKVRQYDQILVEICGHKAIGTVLVGPTPVNIIRRNMLTQLRCTLNFPISPIE
TVPVTLKPGMDGPKVRQWPLTEEKIKALTAICEEMEKEGKITKIGPENPYNTPVFAIRKK
DSTKWRKLVDFRELNKKTQDFWEVQLGIPHPSGLKKKKSVTVLDVGDAYFSVPLDEGFRK
YTAFTIPSTNNETPGIRYQYNVLPQGWKGSPAIFQSSMIKILEPFRAKNPEIVIYQYMDD
LYVGSDLEIGQHRAKVEELREHLLRWGFTTPDKKHQNEPPFLWMGYELHPDKWTVQPIQL
PEKDSWTVNDIQRLVGKLNWASQIYAGIKVKQLCKLLRGAKALTDIVPLTEEAELELAEN
REILKTPVHGVYYDPSKDLIAEIQKQGQDQWSYQIYQEPFKNLKTGKYARTRGAHTNDVR
QLTEAVQKIAQECIVIWGKTPKFKLPIQKDTWETWWMDYWQATWIPKWEFVNTPPLVKLW
YQLEKDPIAGVETFYVDGAANRETKIGKAGYVTDKGRQKVVTLTETTNQKTELHAIYLAL
QDSGSEVNVVTDSQYALGIIQAQPDRSESELVNQIIEKLIGKDKVYLSWVPAHKGIGENE
QVDKLVSNGIRKVLFLDGIDKAQEDHEKYHSNWRAMANEFNLPPIVAKEIVANCDKCQLK
GEAMHGQVDCSPGIWQIDCTHLEGKVILVAVHVASGYLEAEVIPAETGQEAAYFILKLAG
RWPVKTVHTDNGSNFTSNAVKAACWWANVRQEFGIPYNPQSQGVIESMNKELKKIIGQVR
DQAEHLRTAVQMAVFIHNFKRRGGIGGYSAGERMIDIIATDIQTTELQKQITKIQKFRVY
YRDSRDPLWKGPAKLLWKGEGAVVIQENSDIKVVPRRKAKIIKDYGKQVAGADCVAGRQD
EDQ
```

IMMUNOGENIC COMPOSITIONS COMPRISING HUMAN IMMUNODEFICIENCY VIRUS (HIV) MOSAIC NEF PROTEINS

This application is the U.S. national phase of International Application No. PCT/US2006/032907, filed 23 Aug. 2006, which designated the U.S. and claims priority to U.S. Provisional Application Nos. 60/710,154, filed 23 Aug. 2005, and 60/739,413, filed 25 Nov. 2005, the entire contents of each of which are hereby incorporated by reference.

This invention was made with Government support under Contract No. DE-AC52-06NA25396 awarded by the U.S. Department of Energy. The Government has certain rights in the invention.

SEQUENCE

The instant application contains a "lengthy" Sequence Listing which has been submitted via CD-R in lieu of a printed paper copy, and is hereby incorporated by reference in its entirety. The attached CD-Rs, recorded on Apr. 20, 2009, are labeled CRF, "Copy 1" and "Copy 2", and contain identical copies of a 869 KB file named (1579-1300.TXT).

TECHNICAL FIELD

The present invention relates, in general, to an immunogenic composition (e.g., a vaccine) and, in particular, to a polyvalent immunogenic composition, such as a polyvalent HIV vaccine, and to methods of using same. The invention further relates to methods that use a genetic algorithm to create sets of polyvalent antigens suitable for use, for example, in vaccination strategies.

BACKGROUND

Designing an effective HIV vaccine is a many-faceted challenge. The vaccine preferably elicits an immune response capable of either preventing infection or, minimally, controlling viral replication if infection occurs, despite the failure of immune responses to natural infection to eliminate the virus (Nabel, Vaccine 20:1945-1947 (2002)) or to protect from superinfection (Altfeld et al, Nature 420:434-439 (2002)). Potent vaccines are needed, with optimized vectors, immunization protocols, and adjuvants (Nabel, Vaccine 20:1945-1947 (2002)), combined with antigens that can stimulate cross-reactive responses against the diverse spectrum of circulating viruses (Gaschen et al, Science 296:2354-2360 (2002), Korber et al, Br. Med. Bull. 58:19-42 (2001)). The problems that influenza vaccinologists have confronted for decades highlight the challenge posed by HIV-1: human influenza strains undergoing antigenic drift diverge from one another by around 1-2% per year, yet vaccine antigens often fail to elicit cross-reactive B-cell responses from one year to the next, requiring that contemporary strains be continuously monitored and vaccines be updated every few years (Korber et al, Br. Med. Bull. 58:19-42 (2001)). In contrast, co-circulating individual HIV-1 strains can differ from one another by 20% or more in relatively conserved proteins, and up to 35% in the Envelope protein (Gaschen et al, Science 296:2354-2360 (2002), Korber et al, Br. Med. Bull. 58:19-42 (2001)).

Different degrees of viral diversity in regional HIV-1 epidemics provide a potentially useful hierarchy for vaccine design strategies. Some geographic regions recapitulate global diversity, with a majority of known HIV-1 subtypes, or clades, co-circulating (e.g., the Democratic Republic of the Congo (Mokili & Korber, J. Neurovirol 11(Suppl. 1):66-75 (2005)); others are dominated by two subtypes and their recombinants (e.g., Uganda (Barugahare et al, J. Virol. 79:4132-4139 (2005)), and others by a single subtype (e.g., South Africa (Williamson et al, AIDS Res. Hum. Retroviruses 19:133-144 (2003)). Even areas with predominantly single-subtype epidemics must address extensive within-clade diversity (Williamson et al, AIDS Res. Hum. Retroviruses 19:133-44 (2003)) but, since international travel can be expected to further blur geographic distinctions, all nations would benefit from a global vaccine.

Presented herein is the design of polyvalent vaccine antigen sets focusing on T lymphocyte responses, optimized for either the common B and C subtypes, or all HIV-1 variants in global circulation [the HIV-1 Main (M) group]. Cytotoxic T-lymphocytes (CTL) directly kill infected, virus-producing host cells, recognizing them via viral protein fragments (epitopes) presented on infected cell surfaces by human leukocyte antigen (HLA) molecules. Helper T-cell responses control varied aspects of the immune response through the release of cytokines. Both are likely to be crucial for an HIV-1 vaccine: CTL responses have been implicated in slowing disease progression (Oxenius et al, J. Infect. Dis. 189:1199-208 (2004)); vaccine-elicited cellular immune responses in nonhuman primates help control pathogenic SIV or SHIV, reducing the likelihood of disease after challenge (Barouch et al, Science 290:486-92 (2000)); and experimental depletion of CD8+ T-cells results in increased viremia in SIV infected rhesus macaques Schmitz et al, Science 283:857-60 (1999)). Furthermore, CTL escape mutations are associated with disease progression (Barouch et al, J. Virol. 77:7367-75 (2003)), thus vaccine-stimulated memory responses that block potential escape routes may be valuable.

The highly variable Env protein is the primary target for neutralizing antibodies against HIV; since immune protection will likely require both B-cell and T-cell responses (Moore and Burton, Nat. Med. 10:769-71 (2004)), Env vaccine antigens will also need to be optimized separately to elicit antibody responses. T-cell-directed vaccine components, in contrast, can target the more conserved proteins, but even the most conserved HIV-1 proteins are diverse enough that variation is an issue. Artificial central-sequence vaccine approaches (e.g., consensus sequences, in which every amino acid is found in a plurality of sequences, or maximum likelihood reconstructions of ancestral sequences (Gaschen et al, Science 296:2354-60 (2002), Gao et al, J. Virol. 79:1154-63 (2005), Doria-Rose et al, J. Virol. 79:11214-24 (2005), Weaver et al, J. Virol., in press)) are promising; nevertheless, even centralized strains provide limited coverage of HIV-1 variants, and consensus-based reagents fail to detect many autologous T-cell responses (Altfeld et al, J. Virol. 77:733040 (2003)).

Single amino acid changes can allow an epitope to escape T-cell surveillance; since many T-cell epitopes differ between HIV-1 strains at one or more positions, potential responses to any single vaccine antigen are limited. Whether a particular mutation results in escape depends upon the specific epitope/ T-cell combination, although some changes broadly affect between-subtype cross-reactivity (Norris et al, AIDS Res. Hum. Retroviruses 20:315-25 (2004)). Including multiple variants in a polyvalent vaccine could enable responses to a broader range of circulating variants, and could also prime the immune system against common escape mutants (Jones et al, J. Exp. Med. 200:1243-56 (2004)). Escape from one T-cell receptor may create a variant that is susceptible to another (Allen et al, J. Virol. 79:12952-60 (2005), Feeney et al, J. Immunol. 174:7524-30 (2005)), so stimulating polyclonal responses to epitope variants may be beneficial (Killian et al, Aids 19:887-96 (2005)). Escape mutations that inhibit processing (Milicic et al, J. Immunol. 175:4618-26 (2005)) or HLA binding (Ammaranond et al, AIDS Res. Hum. Retroviruses 21:395-7 (2005)) cannot be directly countered by a T-cell with a different specificity, but responses to overlapping epitopes may block even some of these escape routes.

The present invention relates to a polyvalent vaccine comprising several "mosaic" proteins (or genes encoding these proteins). The candidate vaccine antigens can be cocktails of k composite proteins (k being the number of sequence variants in the cocktail), optimized to include the maximum number of potential T-cell epitopes in an input set of viral proteins. The mosaics are generated from natural sequences: they resemble natural proteins and include the most common forms of potential epitopes. Since CD8+ epitopes are contiguous and typically nine amino-acids long, sets of mosaics can be scored by "coverage" of nonamers (9-mers) in the natural sequences (fragments of similar lengths are also well represented). 9-Mers not found at least three times can be excluded. This strategy provides the level of diversity coverage achieved by a massively polyvalent multiple-peptide vaccine but with important advantages: it allows vaccine delivery as intact proteins or genes, excludes low-frequency or unnatural epitopes that are not relevant to circulating strains, and its intact protein antigens are more likely to be processed as in a natural infection.

SUMMARY OF THE INVENTION

In general, the present invention relates to an immunogenic composition. More specifically, the invention relates to a polyvalent immunogenic composition (e.g., an HIV vaccine), and to methods of using same. The invention further relates to methods that involve the use of a genetic algorithm to design sets of polyvalent antigens suitable for use as vaccines.

Objects and advantages of the present invention will be clear from the description that follows.

BRIEF DESCRIPTION OF THE DRAWINGS

In FIGS. 1A, 1C and 1E, the scores for each consecutive 9-mer are plotted in their natural order to show how diversity varies in different protein regions; both p24 in the center of Gag and the central region of Nef are particularly highly conserved. In FIGS. 1B, 1D and 1F, the scores for each 9-mer are reordered by coverage (a strategy also used in FIG. 4), to provide a sense of the overall population coverage of a given protein. Coverage of gp120, even with 8 variant 9-mers, is particularly poor (FIGS. 1E and 1F).

FIGS. 2A-2C. Mosaic initialization, scoring, and optimization. FIG. 2A) A set of k populations is generated by random 2-point recombination of natural sequences (1-6 populations of 50-500 sequences each have been tested). One sequence from each population is chosen (initially at random) for the mosaic cocktail, which is subsequently optimized. The cocktail sequences are scored by computing coverage (defined as the mean fraction of natural-sequence 9-mers included in the cocktail, averaged over all natural sequences in the input data set). Any new sequence that covers more epitopes will increase the score of the whole cocktail. FIG. 2B) The fitness score of any individual sequence is the coverage of a cocktail containing that sequence plus the current representatives from other populations. FIG. 2C) Optimization: 1) two "parents" are chosen: the higher-scoring of a randomly chosen pair of recombined sequences, and either (with 50% probability) the higher-scoring sequence of a second random pair, or a randomly chosen natural sequence. 2) Two-point recombination between the two parents is used to generate a "child" sequence. If the child contains unnatural or rare 9-mers, it is immediately rejected, otherwise it is scored (Gaschen et al, Science 296:2354-2360 (2002)). If the score is higher than that of any of four randomly-selected population members, the child is inserted in the population in place of the weakest of the four, thus evolving an improved population; 4) if its score is a new high score, the new child replaces the current cocktail member from its population. Ten cycles of child generation are repeated for each population in turn, and the process iterates until improvement stalls.

FIG. 4A) Non-optimal natural sequences selected from among strains being used in vaccine studies (Kong et al, J. Virol. 77:12764-72 (2003)) including an individual clade A, B, and C viral sequences (Gag: GenBank accession numbers AF004885, K03455, and U52953; Nef core: AF069670, K02083, and U52953). FIG. 4B) Optimum set of natural sequences [isolates US2 (subtype B, USA), 70177 (subtype C, India), and 99TH.R2399 (subtype CRF15_01B, Thailand); accession numbers AY173953, AF533131, and_AF530576] selected by choosing the single sequence with maximum coverage, followed by the sequence that had the best coverage when combined with the first (i.e. the best complement), and so on, selected for M group coverage FIG. 4C) Consensus sequence cocktail (M group, B- and C-subtypes). FIG. 4D) 3 mosaic sequences, FIG. 4E) 4 mosaic sequences, FIG. 4F) 6 mosaic sequences. FIGS. 4D-4F were all optimized for M group coverage.

FIG. 7A: frequencies from 0-60% (for 9-mer frequencies >60%, the distributions are equivalent for all methods). FIG. 7B: Details of low-frequency 9-mers. Natural sequences have large numbers of rare or unique-to-isolate 9-mers (bottom right, FIGS. 7A and 7B); these are unlikely to induce useful vaccine responses. Selecting optimal natural sequences does select for more common 9-mers, but rare and unique 9-mers are still included (top right, FIGS. 7A and 7B). Consensus cocktails, in contrast, under-represent uncommon 9-mers, especially below 20% frequency (bottom left, FIGS. 7A and 7B). For mosaic sequences, the number of lower-frequency 9-mers monotonically increases with the number of sequences (top left, each panel), but unique-to-isolate 9-mers are completely excluded (top left of right panel: * marks the absence of 9-mers with frequencies <0.005).

FIGS. 8A-8D. HLA binding potential of vaccine candidates. FIGS. 8A and 8B) HLA binding motif counts. FIGS. 8C and 8D) number of unfavorable amino acids. In all graphs: natural sequences are marked with black circles (●); consensus sequences with blue triangles (▲); inferred ancestral sequences with green squares (■); and mosaic sequences with red diamonds (♦). Left panel (FIGS. 8A and 8C) shows HLA-binding-motif counts (FIG. 8A) and counts of unfavorable amino acids (FIG. 8C) calculated for individual sequences; Right panel (FIGS. 8B and 8D) shows HLA binding motifs counts (FIG. 8B) and counts of unfavorable amino acids (FIG. 8D) calculated for sequence cocktails. The top portion of each graph (box-and-whiskers graph) shows the distribution of respective counts (motif counts or counts of unfavorable amino acids) based either on alignment of M group sequences (for individual sequences, FIGS. 8A and 8C) or on 100 randomly composed cocktails of three sequences, one from each A, B and C subtypes (for sequence cocktails, FIGS. 8B and 8D). The alignment was downloaded from the Los Alamos HIV database. The box extends from the 25 percentile to the 75 percentile, with the line at the median. The whiskers extending outside the box show the highest and lowest values. Amino acids that are very rarely found as C-terminal anchor residues are G, S, T, P, N, Q, D, E, and H, and tend to be small, polar, or negatively charged (Yusim et al, J. Virol. 76:8757-8768 (2002)). Results are shown for Gag, but the same qualitative results hold for Nef core and complete Nef. The same procedure was done for supertype motifs with results qualitatively similar to the results for HLA binding motifs (data not shown).

FIG. 9. Mosaic protein sets limited to 4 sequences (k=4), spanning Gag and the central region of Nef, optimized for subtype B, subtype C, and the M group. Figure discloses SEQ ID NOS 1-84, respectively, in order of appearance.

FIG. 10. Mosaic sets for Env and Pol. Figure discloses SEQ ID NOS 85-168, respectively, in order of appearance.

DETAILED DESCRIPTION OF THE INVENTION

Figure 1A:
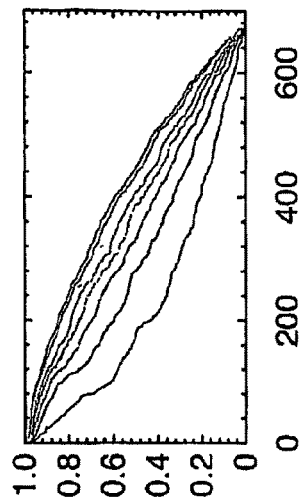
FIGS. 1A-1F. The upper bound of potential epitope coverage of the HIV-1 M group. The upper bound for population coverage of 9-mers for increasing numbers of variants is shown, for k=1-8 variants. A sliding window of length nine was applied across aligned sequences, moving down by one position. Different colors denote results for different numbers of sequences. At each window, the coverage given by the k most common 9-mers is plotted for Gag (FIGS. 1A and 1B), Nef (FIGS. 1C and 1D) and Env gp120 (FIGS. 1E and 1F). Gaps inserted to maintain the alignment are treated as characters. The diminishing returns of adding more variants are evident, since, as k increases, increasingly rare forms are added.
Figure 1C:
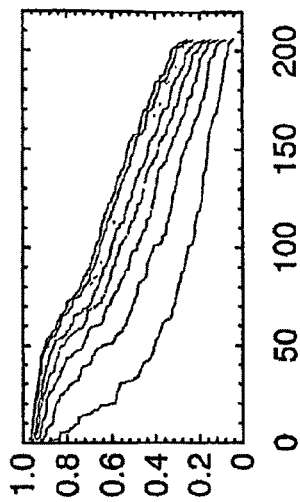
Figure 1E:
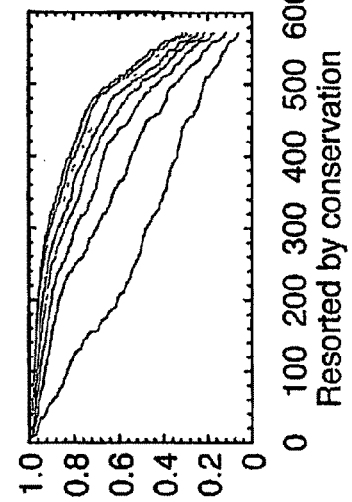
Figure 1B:
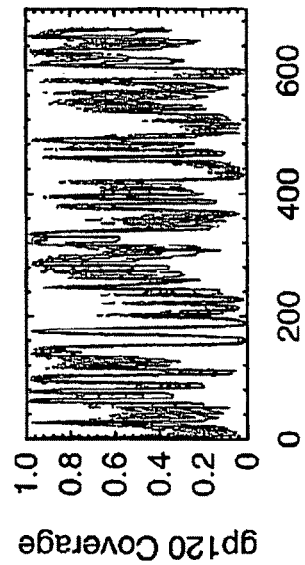
Figure 1D:
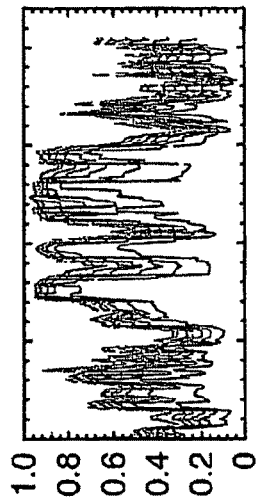
Figure 1F:
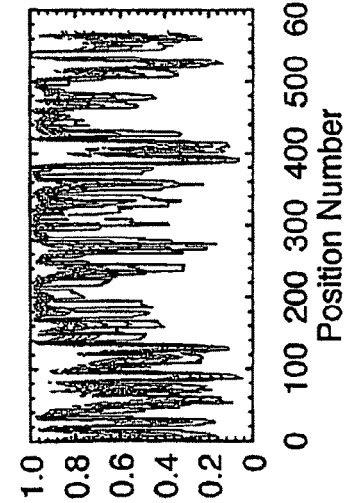

The present invention results from the realization that a polyvalent set of antigens comprising synthetic viral proteins, the sequences of which provide maximum coverage of non-rare short stretches of circulating viral sequences, constitutes a good vaccine candidate. The invention provides a "genetic algorithm" strategy to create such sets of polyvalent antigens as mosaic blends of fragments of an arbitrary set of natural protein sequences provided as inputs. In the context of HIV, the proteins Gag and the inner core (but not the whole) of Nef are ideal candidates for such antigens. The invention further provides optimized sets for these proteins.

The genetic algorithm strategy of the invention uses unaligned protein sequences from the general population as an input data set, and thus has the virtue of being "alignment independent". It creates artificial mosaic proteins that resemble proteins found in nature—the success of the consensus antigens in small animals models suggest this works well. 9 Mers are the focus of the studies described herein, however, different length peptides can be selected depending on the intended target. In accordance with the present approach, 9 mers (for example) that do not exist in nature or that are very rare can be excluded—this is an improvement relative to consensus sequences since the latter can contain some 9 mers (for example) that have not been found in nature, and relative to natural strains that almost invariably contain some 9 mers (for example) that are unique to that strain. The definition of fitness used for the genetic algorithm is that the most "fit" polyvalent cocktail is the combination of mosaic strains that gives the best coverage (highest fraction of perfect matches) of all of the 9 mers in the population and is subject to the constraint that no 9 mer is absent or rare in the population.

The mosaics protein sets of the invention can be optimized with respect to different input data sets—this allows use of current data to assess virtues of a subtype or region specific vaccines from a T cell perspective. By way of example, options that have been compared include:

1) Optimal polyvalent mosaic sets based on M group, B clade and C clade. The question presented was how much better is intra-clade coverage than inter-clade or global.
2) Different numbers of antigens: 1, 3, 4, 6
3) Natural strains currently in use for vaccine protocols just to exemplify "typical" strains (Merck, VRC)
4) Natural strains selected to give the best coverage of 9-mers in a population
5) Sets of consensus: A+B+C.
6) Optimized cocktails that include one "given" strain in a polyvalent antigen, one ancestral+3 mosaic strains, one consensus+3 mosaic strains.
7) Coverage of 9 mers that were perfectly matched was compared with those that match 8/9, 7/9, and 6/9 or less.

This is a computationally difficult problem, as the best set to cover one 9-mer may not be the best set to cover overlapping 9-mers.

It will be appreciated from a reading of this disclosure that the approach described herein can be used to design peptide reagents to test HIV immune responses, and be applied to other variable pathogens as well. For example, the present approach can be adapted to the highly variable virus Hepatitis C.

The proteins/polypeptides/peptides ("immunogens") of the invention can be formulated into compositions with a pharmaceutically acceptable carrier and/or adjuvant using techniques well known in the art. Suitable routes of administration include systemic (e.g. intramuscular or subcutaneous), oral, intravaginal, intrarectal and intranasal.

The immunogens of the invention can be chemically synthesized and purified using methods which are well known to the ordinarily skilled artisan. The immunogens can also be synthesized by well-known recombinant DNA techniques.

Nucleic acids encoding the immunogens of the invention can be used as components of, for example, a DNA vaccine wherein the encoding sequence is administered as naked DNA or, for example, a minigene encoding the immunogen can be present in a viral vector. The encoding sequences can be expressed, for example, in mycobacterium, in a recombinant chimeric adenovirus, or in a recombinant attenuated vesicular stomatitis virus. The encoding sequence can also be present, for example, in a replicating or non-replicating adenoviral vector, an adeno-associated virus vector, an attenuated mycobacterium tuberculosis vector, a Bacillus Calmette Guerin (BCG) vector, a vaccinia or Modified Vaccinia Ankara (MVA) vector, another pox virus vector, recombinant polio and other enteric virus vector, Salmonella species bacterial vector, Shigella species bacterial vector, Venezuelean Equine Encephalitis Virus (VEE) vector, a Semliki Forest Virus vector, or a Tobacco Mosaic Virus vector. The encoding sequence, can also be expressed as a DNA plasmid with, for example, an active promoter such as a CMV promoter. Other live vectors can also be used to express the sequences of the invention. Expression of the immunogen of the invention can be induced in a patient's own cells, by introduction into those cells of nucleic acids that encode the immunogen, preferably using codons and promoters that optimize expression in human cells. Examples of methods of making and using DNA vaccines are disclosed in U.S. Pat. Nos. 5,580,859, 5,589,466, and 5,703,055.

It will be appreciated that adjuvants can be included in the compositions of the invention (or otherwise administered to enhance the immunogenic effect). Examples of suitable adjuvants include TRL-9 agonists, TRL-4 agonists, and TRL-7, 8 and 9 agonist combinations (as well as alum). Adjuvants can take the form of oil and water emulsions. Squalene adjuvants can also be used.

The composition of the invention comprises an immunologically effective amount of the immunogen of this invention, or nucleic acid sequence encoding same, in a pharmaceutically acceptable delivery system. The compositions can be used for prevention and/or treatment of virus infection (e.g. HIV infection). As indicated above, the compositions of the invention can be formulated using adjuvants, emulsifiers, pharmaceutically-acceptable carriers or other ingredients routinely provided in vaccine compositions. Optimum formulations can be readily designed by one of ordinary skill in the art and can include formulations for immediate release and/or for sustained release, and for induction of systemic immunity and/or induction of localized mucosal immunity (e.g, the formulation can be designed for intranasal, intravaginal or intrarectal administration). As noted above, the present compositions can be administered by any convenient route including subcutaneous, intranasal, oral, intramuscular, or other parenteral or enteral route. The immunogens can be administered as a single dose or multiple doses. Optimum immunization schedules can be readily determined by the ordinarily skilled artisan and can vary with the patient, the composition and the effect sought.

The invention contemplates the direct use of both the immunogen of the invention and/or nucleic acids encoding same and/or the immunogen expressed as indicated above. For example, a minigene encoding the immunogen can be used as a prime and/or boost.

The invention includes any and all amino acid sequences disclosed herein, as well as nucleic acid sequences encoding same (and nucleic acids complementary to such encoding sequences).

Specifically disclosed herein are vaccine antigen sets optimized for single B or C subtypes, targeting regional epidemics, as well as for all HIV-1 variants in global circulation [the HIV-1 Main (M) group]. In the study described in the Example that follows, the focus is on designing polyvalent vaccines specifically for T sell responses. HIV-1 specific T-cells are likely to be crucial to an HIV-1-specific vaccine response: CTL responses are correlated with slow disease progression in humans (Oxenius et al, J. Infect. Dis. 189: 1199-1208 (2004)), and the importance of CTL responses in non-human primate vaccination models is well-established.

Vaccine elicited cellular immune responses help control pathogenic SIV or SHIV, and reduce the likelihood of disease after challenge with pathogenic virus (Barouch et al, Science 290:486-492 (2000)). Temporary depletion of CD8+ T cells results in increased viremia in SIV-infected rhesus macaques (Schmitz et al, Science 283:857-860 (1999)). Furthermore, the evolution of escape mutations has been associated with disease progression, indicating that CTL responses help constrain viral replication in vivo (Barouch et al, J. Virol. 77:7367-7375 (2003)), and so vaccine-stimulated memory responses that could block potential escape routes may be of value. While the highly variable Envelope (Env) is the primary target for neutralizing antibodies against HIV, and vaccine antigens will also need to be tailored to elicit these antibody responses (Moore & Burton, Nat. Med. 10:769-771 (2004)), T-cell vaccine components can target more conserved proteins to trigger responses that are more likely to cross-react. But even the most conserved HIV-1 proteins are diverse enough that variation will be an issue. Artificial central-sequence vaccine approaches, consensus and ancestral sequences (Gaschen et al, Science 296:2354-2360 (2002), Gao et al, J. Virol. 79:1154-1163 (2005), Doria-Rose et al, J. Virol. 79:11214-11224 (2005)), which essentially "split the differences" between strains, show promise, stimulating responses with enhanced cross-reactivity compared to natural strain vaccines (Gao et al, J. Virol. 79:1154-1163 (2005)) (Liao et al. and Weaver et al., submitted.) Nevertheless, even central strains cover the spectrum of HIV diversity to a very limited extent, and consensus-based peptide reagents fail to detect many autologous CD8+ T-cell responses (Altfeld et al, J. Virol. 77:7330-7340 (2003)).

A single amino acid substitution can mediate T-cell escape, and as one or more amino acids in many T-cell epitopes differ between HIV-1 strains, the potential effectiveness of responses to any one vaccine antigen is limited. Whether a particular mutation will diminish T-cell cross-reactivity is epitope- and T-cell-specific, although some changes can broadly affect between-clade cross-reactivity (Norris et al, AIDS Res. Hum. Retroviruses 20:315-325 (2004)). Including more variants in a polyvalent vaccine could enable responses to a broader range of circulating variants. It could also prime the immune system against common escape variants (Jones et al, J. Exp. Med. 200:1243-1256 (2004)); escape from one T-cell receptor might create a variant that is susceptible to another (Lee et al, J. Exp. Med. 200:1455-1466 (2004)), thus stimulating polyclonal responses to epitope variants may be beneficial (Killian et al, AIDS 19:887-896 (2005)). Immune escape involving avenues that inhibit processing (Milicic et al, J. Immunol. 175:4618-4626 (2005)) or HLA binding (Ammaranond et al, AIDS Res. Hum. Retroviruses 21:395-397 (2005)) prevent epitope presentation, and in such cases the escape variant could not be countered by a T-cell with a different specificity. However, it is possible the presence of T-cells that recognize overlapping epitopes may in some cases block these even escape routes.

Certain aspects of the invention can be described in greater detail in the non-limiting Example that follows.

Example

Experimental Details

HIV-1 sequence data. The reference alignments from the 2005 HIV sequence database (URL: hiv-dot-lanl-dot-gov), which contain one sequence per person, were used, supplemented by additional recently available C subtype Gag and Nef sequences from Durban, South Africa (GenBank accession numbers AY856956-AY857186) (Kiepiela et al, Nature 432:769-75 (2004)). This set contained 551 Gag and 1,131 Nef M group sequences from throughout the globe; recombinant sequences were included as well as pure subtype sequences for exploring M group diversity. The subsets of these alignments that contained 18 A, 102 B, 228 C, and 6 G subtype (Gag), and 62 A, 454 B, 284 C, and 13 G subtype sequences (Nef) sequences were used for within- and between-single-clade optimizations and comparisons.

The genetic algorithm. GAs are computational analogues of biological processes (evolution, populations, selection, recombination) used to find solutions to problems that are difficult to solve analytically (Holland, Adaptation in Natural and Artificial Systems: An Introductory Analysis with Applications to Biology, Control, and Artificial Intelligence, (M.I.T. Press, Cambridge, Mass. (1992))). Solutions for a given input are "evolved" though a process of random modification and selection according to a "fitness" (optimality) criterion. GAs come in many flavors; a "steady-state co-evolutionary multi-population" GA was implemented. "Steady-state" refers to generating one new candidate solution at a time, rather than a whole new population at once; and "co-evolutionary" refers to simultaneously evolving several distinct populations that work together to form a complete solution. The input is an unaligned set of natural sequences; a candidate solution is a set of k pseudo-natural "mosaic" sequences, each of which is formed by concatenating sections of natural sequences. The fitness criterion is population coverage, defined as the proportion of all 9-amino-acid sequence fragments (potential epitopes) in the input sequences that are found in the cocktail.

To initialize the GA (FIG. 2), k populations of n initial candidate sequences are generated by 2-point recombination between randomly selected natural sequences. Because the input natural sequences are not aligned, "homologous" crossover is used: crossover points in each sequence are selected by searching for short matching strings in both sequences; strings of c−1=8, were used where a typical epitope length is c=9. This ensures that the recombined sequences resemble natural proteins: the boundaries between sections of sequence derived from different strains are seamless, the local sequences spanning the boundaries are always found in nature, and the mosaics are prevented from acquiring large insertions/deletions or unnatural combinations of amino acids. Mosaic sequence lengths fall within the distribution of natural sequence lengths as a consequence of mosaic construction: recombination is only allowed at identical regions, reinforced by an explicit software prohibition against excessive lengths to prevent reduplication of repeat regions. (Such "in frame" insertion of reduplicated epitopes could provide another way of increasing coverage without generating unnatural 9-mers, but their inclusion would create "unnatural" proteins.) Initially, the cocktail contains one randomly chosen "winner" from each population. The fitness score for any individual sequence in a population is the coverage value for the cocktail consisting of that sequence plus the current winners from the other populations. The individual fitness of any sequence in a population therefore depends dynamically upon the best sequences found in the other populations.

Optimization proceeds one population at a time. For each iteration, two "parent" sequences are chosen. The first parent is chosen using "2-tournament" selection: two sequences are picked at random from the current population, scored, and the better one is chosen. This selects parents with a probability inversely proportional to their fitness rank within the population, without the need to actually compute the fitness of all individuals. The second parent is chosen in the same way (50% of the time), or is selected at random from the set of natural sequences. 2-point homologous crossover between the parents is then used to generate a "child" sequence. Any child containing a 9-mer that was very rare in the natural population (found less than 3 times) is rejected immediately. Otherwise, the new sequence is scored, and its fitness is compared with the fitnesses of four randomly chosen sequences from the same population. If any of the four randomly chosen sequences has a score lower than that of the new sequence, it is replaced in the population by the new sequence. Whenever a sequence is encountered that yields a better score than the current population "winner", that sequence becomes the winner for the current population and so is subsequently used in the cocktail to evaluate sequences in other populations. A few such optimization cycles (typically 10) are applied to each population in turn, and this process continues cycling through the populations until evolution stalls (i.e., no improvement has been made for a defined number of generations). At this point, the entire procedure is restarted using newly generated random starting populations, and the restarts are continued until no further improvement is seen. The GA was run on each data set with n=50 or 500; each run was continued until no further improvement occurred for 12-24 hours on a 2 GHz Pentium processor. Cocktails were generated having k=1, 3, 4, or 6 mosaic sequences.

The GA also enables optional inclusion of one or more fixed sequences of interest (for example, a consensus) in the cocktail and will evolve the other elements of the cocktail in order to optimally complement that fixed strain. As these solutions were suboptimal, they are not included here. An additional program selects from the input file the k best natural strains that in combination provide the best population coverage.

Comparison with other polyvalent vaccine candidates. Population coverage scores were computed for other potential mono- or polyvalent vaccines to make direct comparisons with the mosaic-sequence vaccines, tracking identities with population 9-mers, as well as similarities of 8/9 and 7/9 amino acids. Potential vaccine candidates based on natural strains include single strains (for example, a single C strain for a vaccine for southern Africa (Williamson et al, AIDS Res. Hum. Retroviruses 19:133-44 (2003))) or combinations of natural strains (for example, one each of subtype A, B, and C (Kong et al, J. Virol. 77:12764-72 (2003)). To date, natural-strain vaccine candidates have not been systematically selected to maximize potential T-cell epitope coverage; vaccine candidates were picked from the literature to be representative of what could be expected from unselected vaccine candidates. An upper bound for coverage was also determined using only intact natural strains: optimal natural-sequence cocktails were generated by selecting the single sequence with the best coverage of the dataset, and then successively adding the most complementary sequences up to a given k. The comparisons included optimal natural-sequence cocktails of various sizes, as well as consensus sequences, alone or in combination (Gaschen et al, Science 296:2354-60 (2002)), to represent the concept of central, synthetic vaccines. Finally, using the fixed-sequence option in the GA, consensus-plus-mosaic combinations in the comparisons; these scores were essentially equivalent to all-mosaic combinations were included for a given k (data not shown). The code used for performing these analyses are available at: ftp://ftp-t10/pub/btk/mosaics.
Results Protein Variation. In conserved HIV-1 proteins, most positions are essentially invariant, and most variable positions have only two to three amino acids that occur at appreciable frequencies, and variable positions are generally well dispersed between conserved positions. Therefore, within the boundaries of a CD8+ T-cell epitope (8-12 amino acids, typically nine), most of the population diversity can be covered with very few variants. FIG. 1 shows an upper bound for population coverage of 9-mers (stretches of nine contiguous amino acids) comparing Gag, Nef, and Env for increasing numbers of variants, sequentially adding variants that provide the best coverage. In conserved regions, a high degree of population coverage is achieved with 2-4 variants. By contrast, in variable regions like Env, limited population coverage is possible even with eight variants, Since each new addition is rarer, the relative benefits of each addition diminish as the number of variants increases.

Vaccine design optimization strategies. FIG. 1 shows an idealized level of 9-mer coverage. In reality, high-frequency 9-mers often conflict: because of local co-variation, the optimal amino acid for one 9-mer may differ from that for an overlapping 9-mer. To design mosaic protein sets that optimize population coverage, the relative benefits of each amino acid must be evaluated in combination with nearby variants. For example, Alanine (Ala) and Glutamate (Glu) might each frequently occur in adjacent positions, but if the Ala-Glu combination is never observed in nature, it should be excluded from the vaccine. Several optimization strategies were investigated: a greedy algorithm, a semi-automated compatible-9mer assembly strategy, an alignment-based genetic algorithm (GA), and an alignment-independent GA.

The alignment-independent GA generated mosaics with the best population coverage. This GA generates a user-specified number of mosaic sequences from a set of unaligned protein sequences, explicitly excluding rare or unnatural epitope-length fragments (potentially introduced at recombination breakpoints) that could induce non-protective vaccine-antigen-specific responses. These candidate vaccine sequences resemble natural proteins, but are assembled from frequency-weighted fragments of database sequences recombined at homologous breakpoints (FIG. 2); they approach maximal coverage of 9-mers for the input population.

Figure 3:
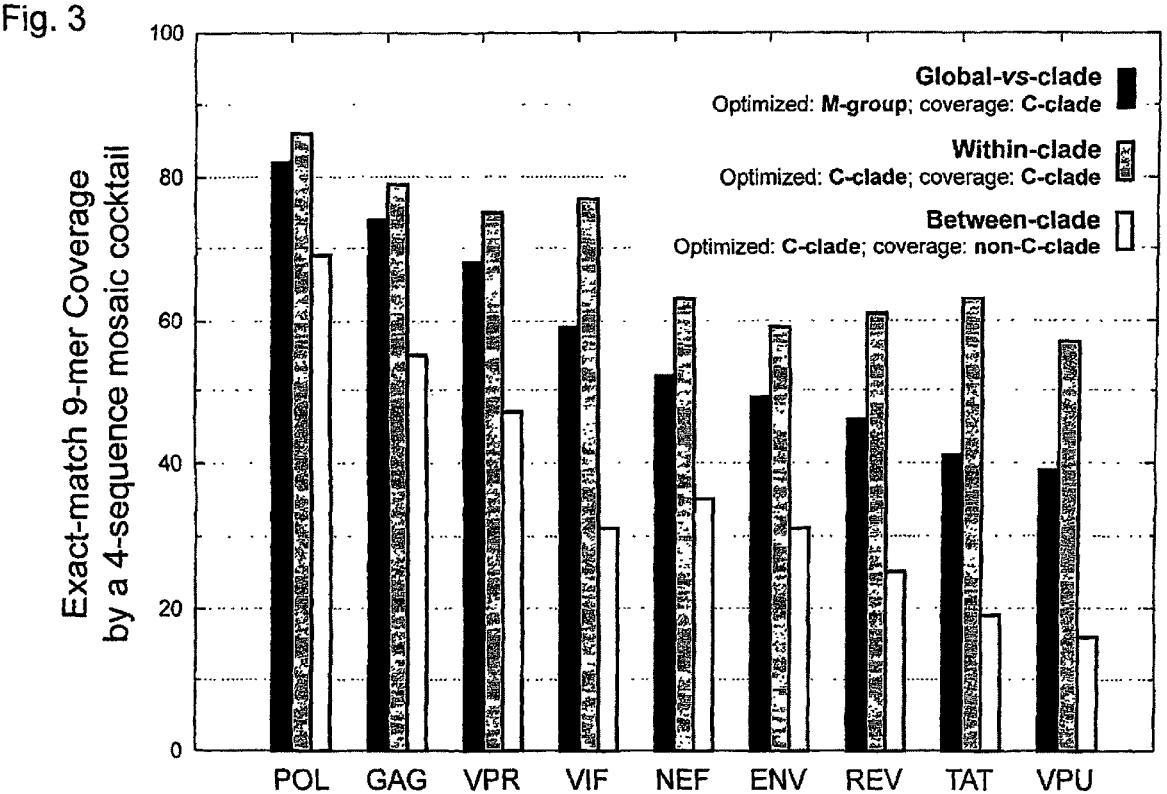
FIG. 3. Mosaic strain coverage for all HIV proteins. The level of 9-mer coverage achieved by sets of four mosaic proteins for each HIV protein is shown, with mosaics optimized using either the M group or the C subtype. The fraction of C subtype sequence 9-mers covered by mosaics optimized on the C subtype (within-clade optimization) is shown in gray. Coverage of 9 mers found in non-C subtype M-group sequences by subtype-C-optimized mosaics (between-clade coverage) is shown in white. Coverage of subtype C sequences by M-group optimized mosaics is shown in black. B clade comparisons gave comparable results (data not shown).
Figure 4A:
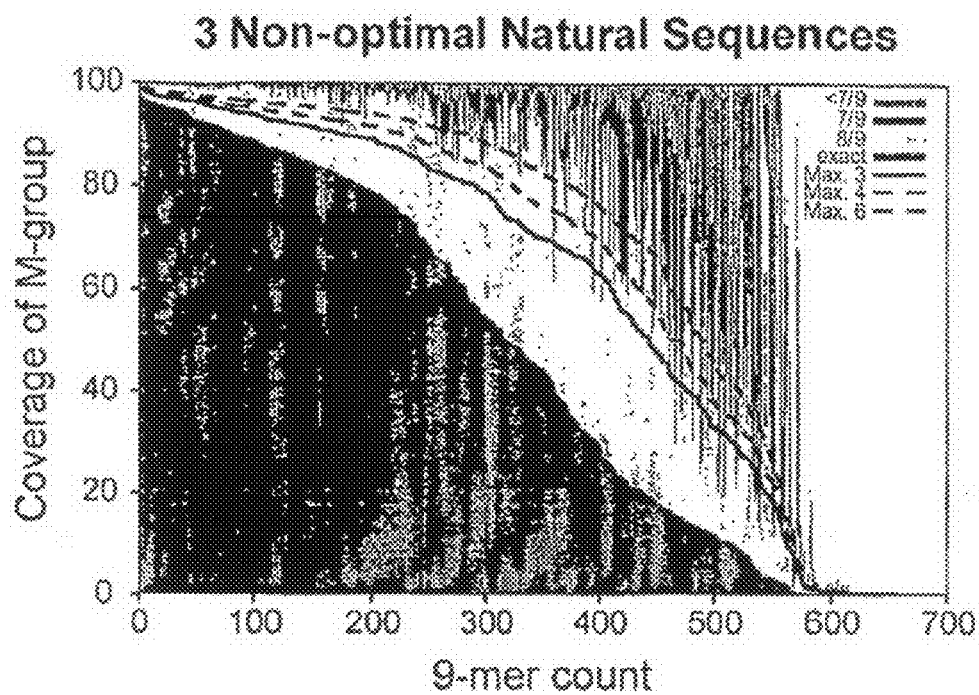
FIGS. 4A-4F. Coverage of M group sequences by different vaccine candidates, nine-mer by nine-mer. Each plot presents site-by-site coverage (i.e., for each nine-mer) of an M-group natural-sequence alignment by a single tri-valent vaccine candidate. Bars along the x-axis represent the proportion of sequences matched by the vaccine candidate for a given alignment position: 9/9 matches (in red), 8/9 (yellow), 7/9 (blue). Aligned 9-mers are sorted along the x-axis by exact-match coverage value. 656 positions include both the complete Gag and the central region of Nef. For each alignment position, the maximum possible matching value (i.e. the proportion of aligned sequences without gaps in that nine-mer) is shown in gray.
Figure 4B:
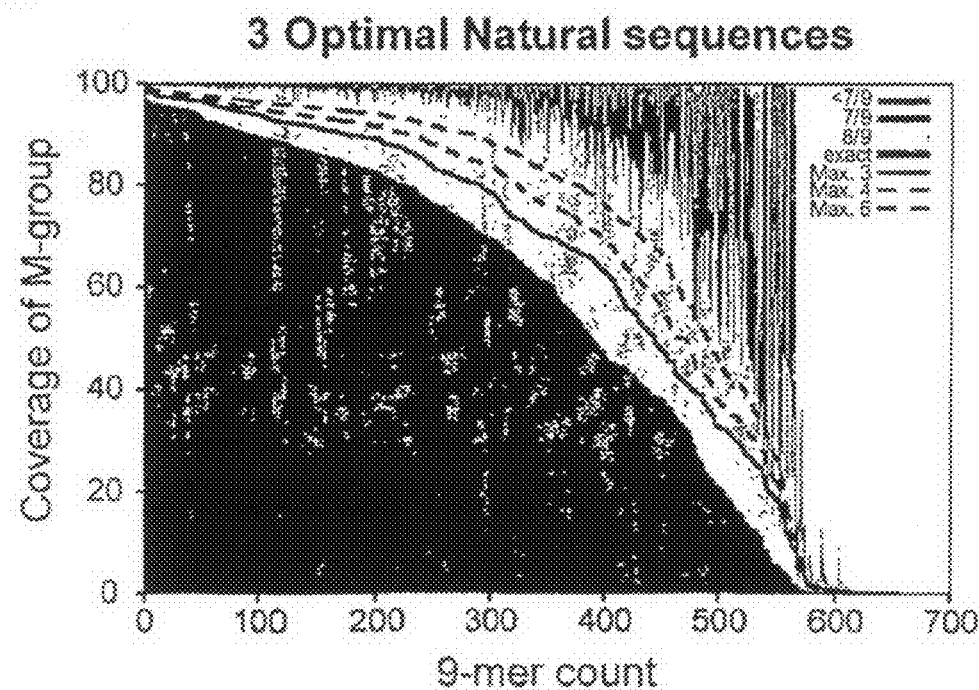
Figure 4C:
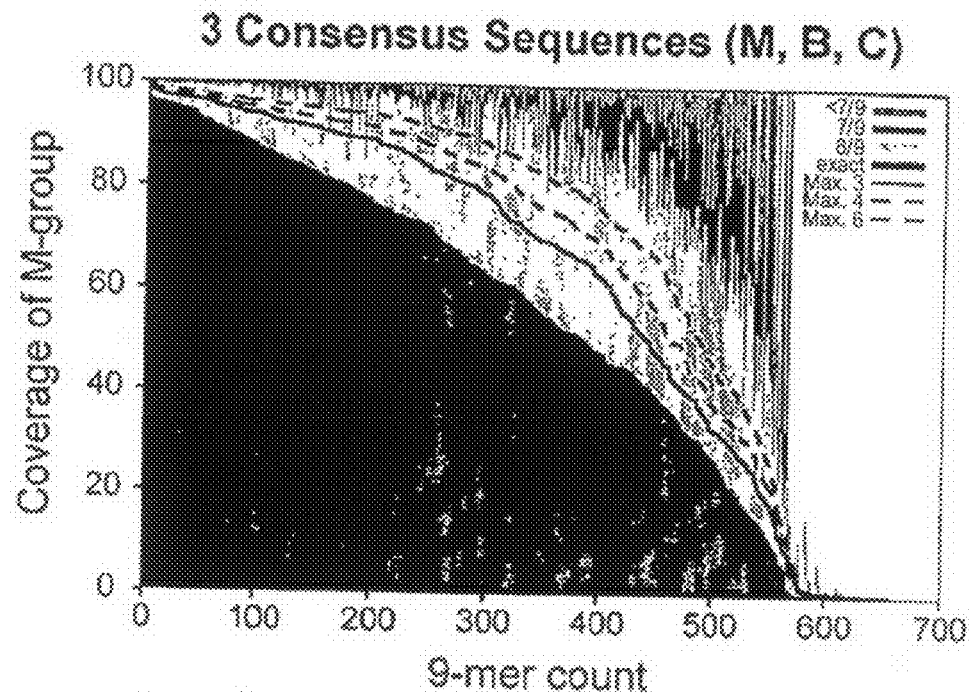
Figure 4D:
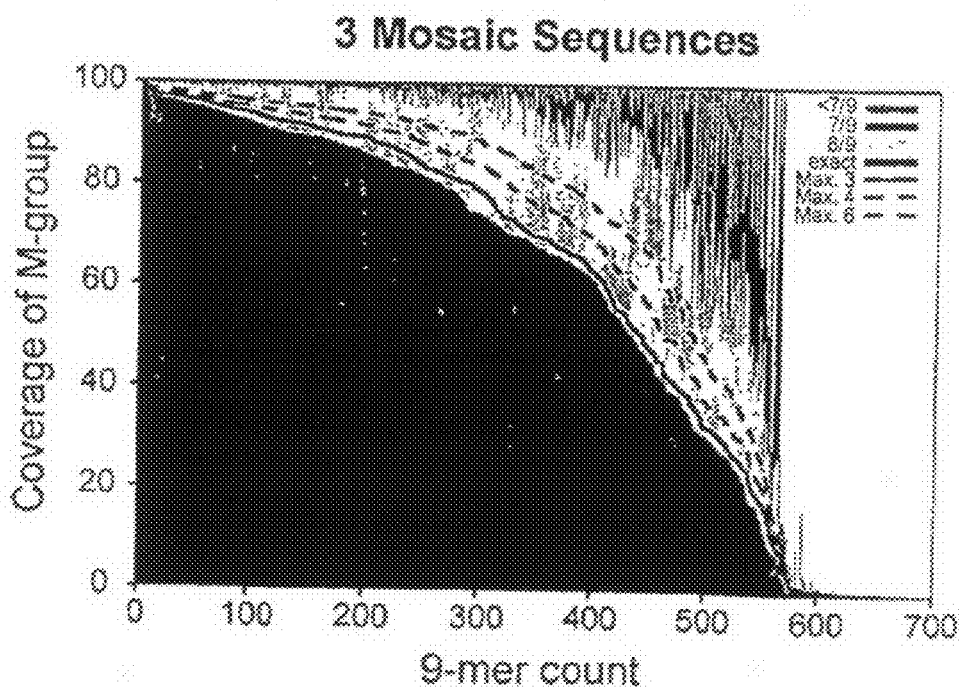
Figure 4E:
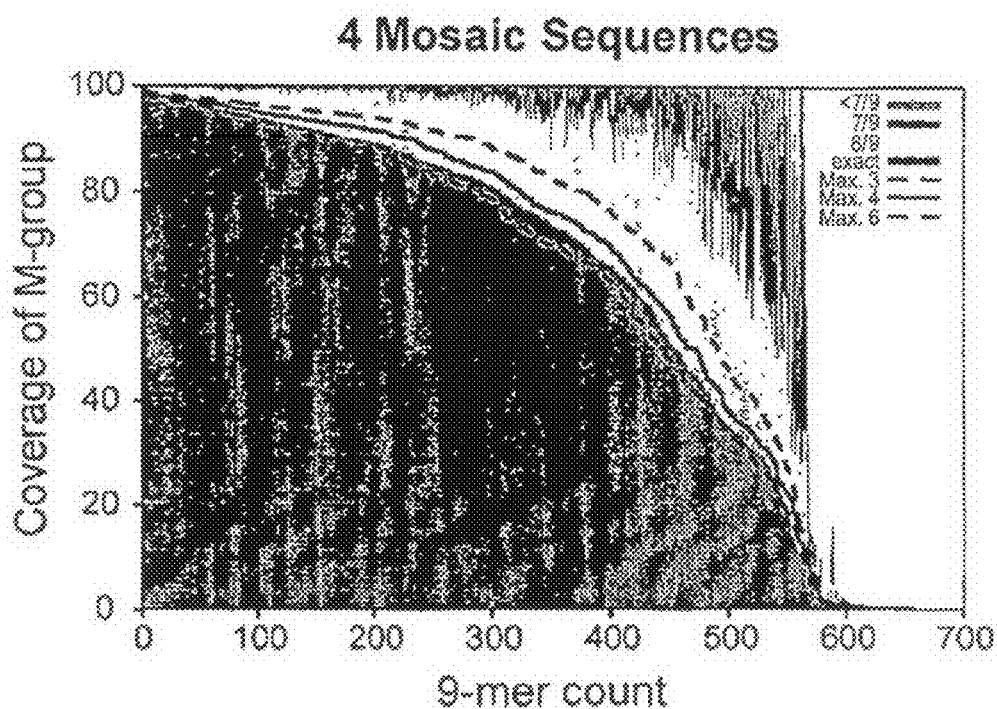
Figure 4F:
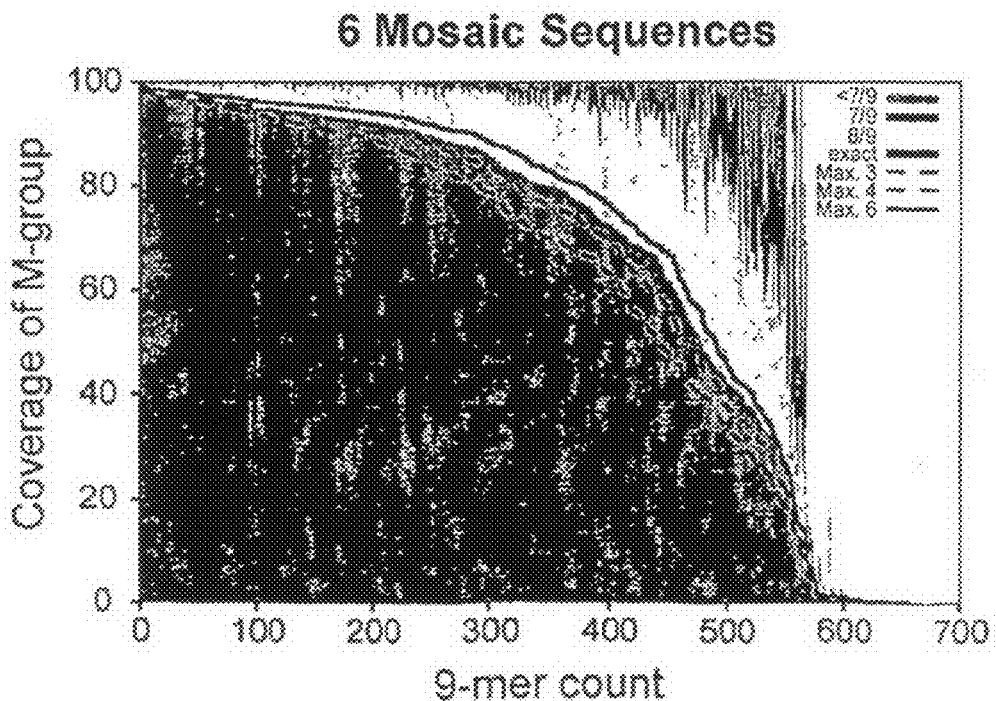

Selecting HIV protein regions for an initial mosaic vaccine. The initial design focused on protein regions meeting specific criteria: i) relatively low variability, ii) high levels of recognition in natural infection, iii) a high density of known epitopes and iv) either early responses upon infection or CD8+ T-cell responses associated with good outcomes in infected patients. First, an assessment was made of the level of 9-mer coverage achieved by mosaics for different HIV proteins (FIG. 3). For each protein, a set of four mosaics was generated using either the M group or the B- and C-subtypes alone; coverage was scored on the C subtype. Several results are notable: i) within-subtype optimization provides the best within-subtype coverage, but substantially poorer between-subtype coverage—nevertheless, B-subtype-optimized mosaics provide better C-subtype coverage than a single natural B subtype protein (Kong et al, J. Virol. 77:12764-72 (2003)); ii) Pol and Gag have the most potential to elicit broadly cross-reactive responses, whereas Rev, Tat, and Vpu have even fewer conserved 9-mers than the highly variable Env protein, iii) within-subtype coverage of M-group-optimized mosaic sets approached coverage of within-subtype optimized sets, particularly for more conserved proteins.

Gag and the central region of Nef meet the four criteria listed above. Nef is the HIV protein most frequently recognized by T-cells (Frahm et al, J. Virol. 78:2187-200 (2004)) and the target for the earliest response in natural infection (Lichterfeld et al, Aids 18:1383-92 (2004)). While overall it is variable (FIG. 3), its central region is as conserved as Gag (FIG. 1). It is not yet clear what optimum proteins for inclusion in a vaccine might be, and mosaics could be designed to maximize the potential coverage of even the most variable proteins (FIG. 3), but the prospects for global coverage are better for conserved proteins. Improved vaccine protection in macaques has been demonstrated by adding Rev, Tat, and Nef to a vaccine containing Gag, Pol, and Env (Hel et al, J. Immunol. 176:85-96 (2006)), but this was in the context of homologous challenge, where variability was not an issue. The extreme variability of regulatory proteins in circulating virus populations may preclude cross-reactive responses; in terms of conservation, Pol, Gag (particularly p24) and the central region of Nef (HXB2 positions 65-149) are promising potential immunogens (FIGS. 1,3). Pol, however, is infrequently recognized during natural infection (Frahm et al, J. Virol. 78:2187-200 (2004)), so it was not included in the initial immunogen design. The conserved portion of Nef that were included contains the most highly recognized peptides in HIV-1 (Frahm et al, J. Virol. 78:2187-200 (2004)), but as a protein fragment, would not allow Nef's immune inhibitory functions (e.g. HLA class I down-regulation (Blagoveshchenskaya, Cell 111:853-66 (2002))). Both Gag and Nef are densely packed with overlapping well-characterized CD8+ and CD4+ T-cell epitopes, presented by many different HLA molecules (http://www.hiv.lanl.gov//content/immunology/maps/maps.html), and Gag-specific CD8+ (Masemola et al, J. Virol. 78:3233-43 (2004)) and CD4+ (Oxenius et al, J. Infect. Dis. 189:1199-208 (2004)) T-cell responses have been associated with low viral set points in infected individuals (Masemola et al, J. Virol. 78:3233-43 (2004)).

To examine the potential impact of geographic variation and input sample size, a limited test was done using published subtype C sequences. The subtype C Gag data were divided into three sets of comparable size—two South African sets (Kiepiela et al, Nature 432:769-75 (2004)), and one non-South-African subtype C set. Mosaics were optimized independently on each of the sets, and the resulting mosaics were tested against all three sets. The coverage of 9-mers was slightly better for identical training and test sets (77-79% 9/9 coverage), but essentially equivalent when the training and test sets were the two different South African data sets (73-75%), or either of the South African sets and the non-South African C subtype sequences (74-76%). Thus between- and within-country coverage approximated within-clade coverage, and in this case no advantage to a country-specific C subtype mosaic design was found.

Designing mosaics for Gag and Nef and comparing vaccine strategies. To evaluate within- and between-subtype cross-reactivity for various vaccine design strategies, a calculation was made of the coverage they provided for natural M-Group sequences. The fraction of all 9-mers in the natural sequences that were perfectly matched by 9-mers in the vaccine antigens were computed, as well as those having 8/9 or 7/9 matching amino acids, since single (and sometimes double) substitutions within epitopes may retain cross-reactivity. FIG. 4 shows M group coverage per 9-mer in Gag and the central region of Nef for cocktails designed by various strategies: a) three non-optimal natural strains from the A, B, and C subtypes that have been used as vaccine antigens (Kong et al, J. Virol. 77:12764-72 (2003)); b) three natural strains that were computationally selected to give the best M group coverage; c) M group, B subtype, and C subtype consensus sequences; and, d,e,f) three, four and six mosaic proteins. For cocktails of multiple strains, sets of k=3, k=4, and k=6, the mosaics clearly perform the best, and coverage approaches the upper bound for k strains. They are followed by optimally selected natural strains, the consensus protein cocktail, and finally, non-optimal natural strains. Allowing more antigens provides greater coverage, but gains for each addition are reduced as k increases (FIGS. 1 and 4).

Figure 5A:
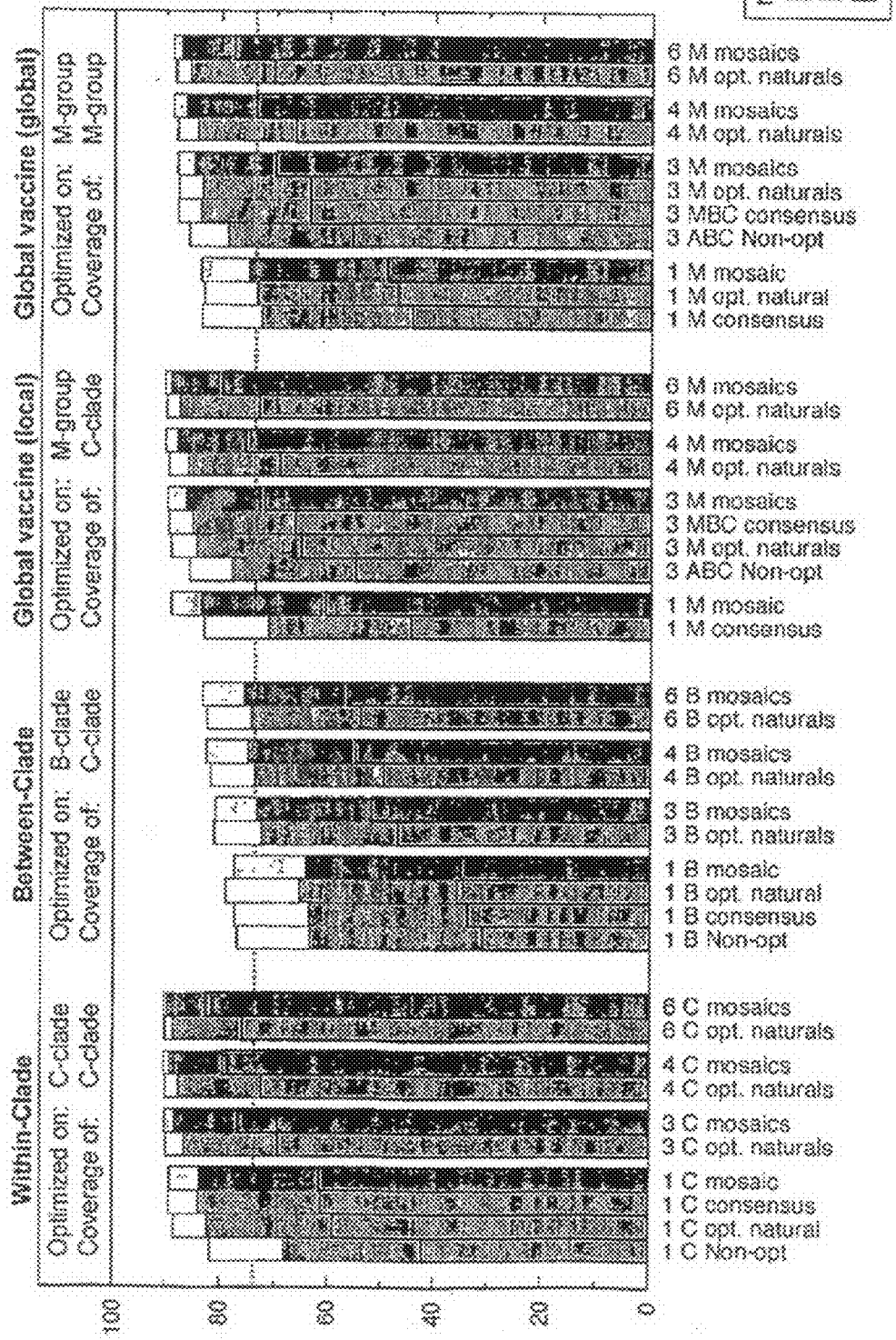
FIGS. 5A and 5B. Overall coverage of vaccine candidates: coverage of 9-mers in C clade sequences using different input data sets for mosaic optimization, allowing different numbers of antigens, and comparing to different candidate vaccines. Exact (blue), 8/9 (one-off; red), and 7/9 (two-off; yellow) coverage was computed for mono- and polyvalent vaccine candidates for Gag (FIG. 5A) and Nef (core) (FIG. 5B) for four test situations: within-clade (C-clade-optimized candidates scored for C-clade coverage), between-clade (B-clade-optimized candidates scored for C-clade coverage), global-against-single-subtype (M-group-optimized candidates scored for C-clade coverage), global-against-global (M-group-optimized candidates scored for global coverage). Within each set of results, vaccine candidates are grouped by number of sequences in the cocktail (1-6); mosaic sequences are plotted with darker colors. "Non-opt" refers to one set of sequences moving into vaccine trials (Kong et al, J. Virol. 77:12764-72 (2003)); "mosaic" denotes sequences generated by the genetic algorithm; "opt. natural" denotes intact natural sequences selected for maximum 9-mer coverage; "MBC consensus" denotes a cocktail of 3 consensus sequences, for M-group, B-subtype, and C-subtype. For ease of comparison, a dashed line marks the coverage of a 4-sequence set of M-group mosaics (73.7-75.6%). Over 150 combinations of mosaic-number, virus subset, protein region, and optimization and test sets were tested. The C clade/B clade/M group comparisons illustrated in this figure are generally representative of within-clade, between-clade, and M group coverage. In particular, levels of mosaic coverage for B and C clade were very similar, despite there being many more C clade sequences in the Gag collection, and many more B clade sequences in the Nef collection (see FIG. 6 for a full B and C clade comparison). There were relatively few A and G clade sequences in the alignments (24 Gag, 75 Nef), and while 9-mer coverage by M-group optimized mosaics was not as high as for subtypes for B and C clades (4-mosaic coverage for A and G subtypes was 63% for Gag, 74% for Nef), it was much better than a non-optimal cocktail (52% Gag, 52% for Nef).
Figure 5B:
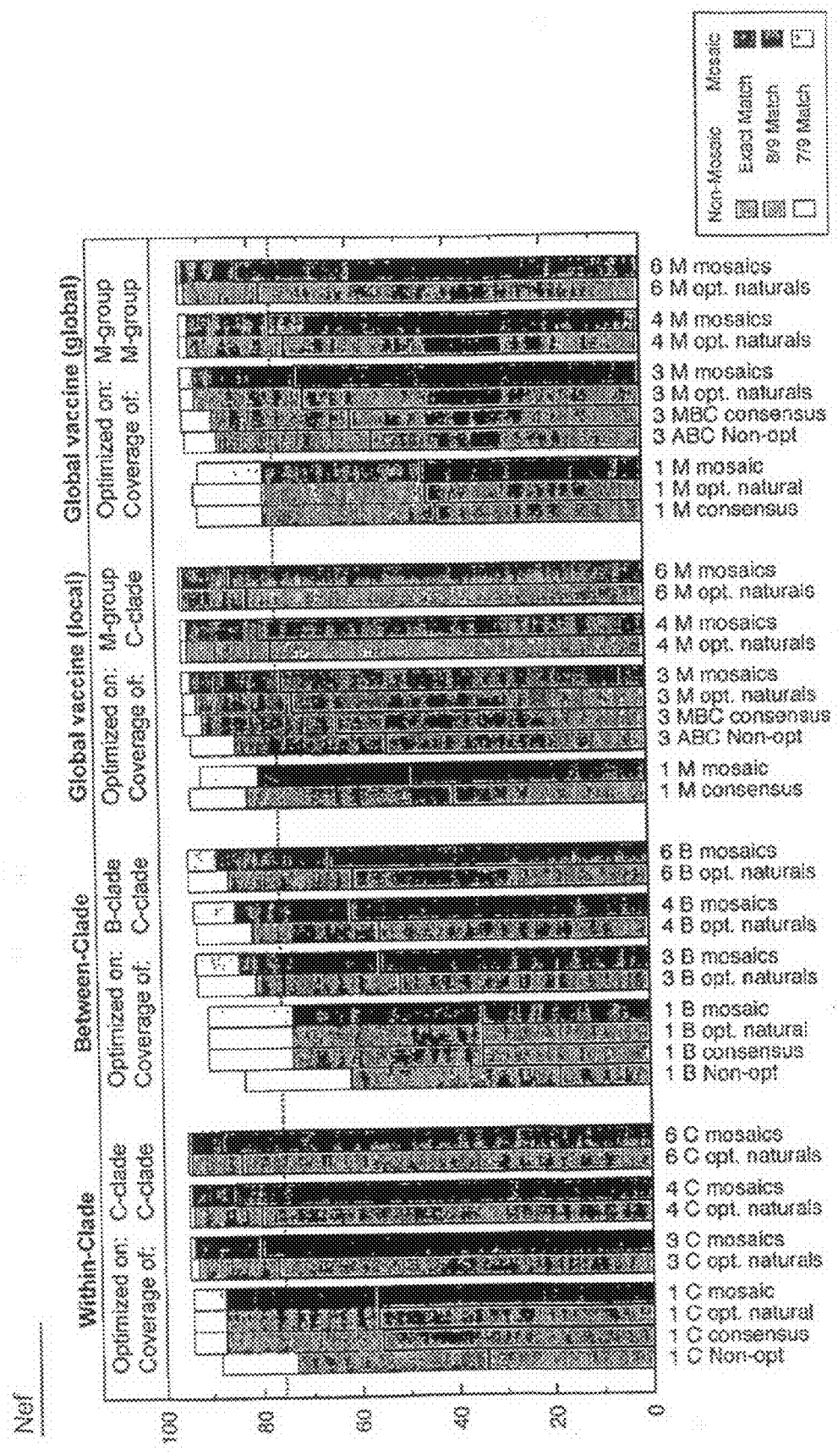
Figure 6A:
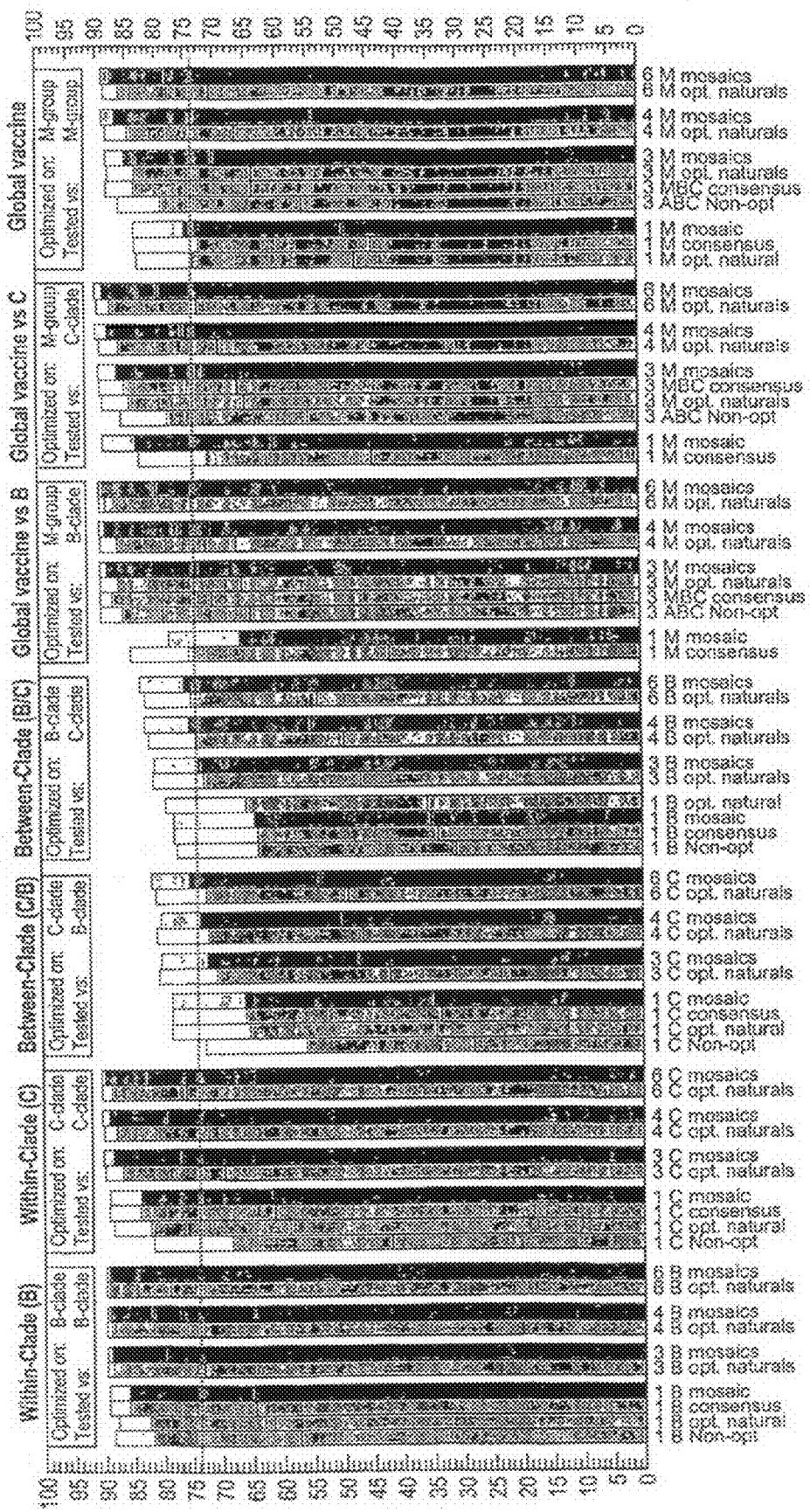
FIGS. 6A and 6B. Overall coverage of vaccine candidates: coverage of 9-mers in B-clade, C-clade, and M-group sequences using different input data sets for mosaic optimization, allowing different numbers of antigens, and comparing to different candidate vaccines. Exact (blue), 8/9 (one-off; red), and 7/9 (two-off; yellow) coverage was computed for mono- and polyvalent vaccine candidates for Gag (FIG. 6A) and Nef (core) (FIG. 6B) for seven test situations: within-clade (B- or C-clade-optimized candidates scored against the same clade), between-clade (B- or C-clade-optimized candidates scored against the other clade), global vaccine against single subtype (M-group-optimized candidates scored against B- or C-clade), global vaccine against global viruses (M-group-optimized candidates scored against all M-group sequences). Within each set of results, vaccine candidates are grouped by number of sequences in the cocktail (1-6); mosaic sequences are plotted with darker colors. "Non-opt" refers to a particular set of natural sequences previously proposed for a vaccine (Kong, W. P. et al. J Virol 77, 12764-72 (2003)); "mosaic" denotes sequences generated by the genetic algorithm; "opt. natural" denotes intact natural sequences selected for maximum 9-mer coverage; "MBC consensus" denotes a cocktail of 3 consensus sequences, for M-group, B-subtype, and C-subtype. A dashed line is shown at the level of exact-match M-group coverage for a 4-valent mosaic set optimized on the M-group.
Figure 6B:
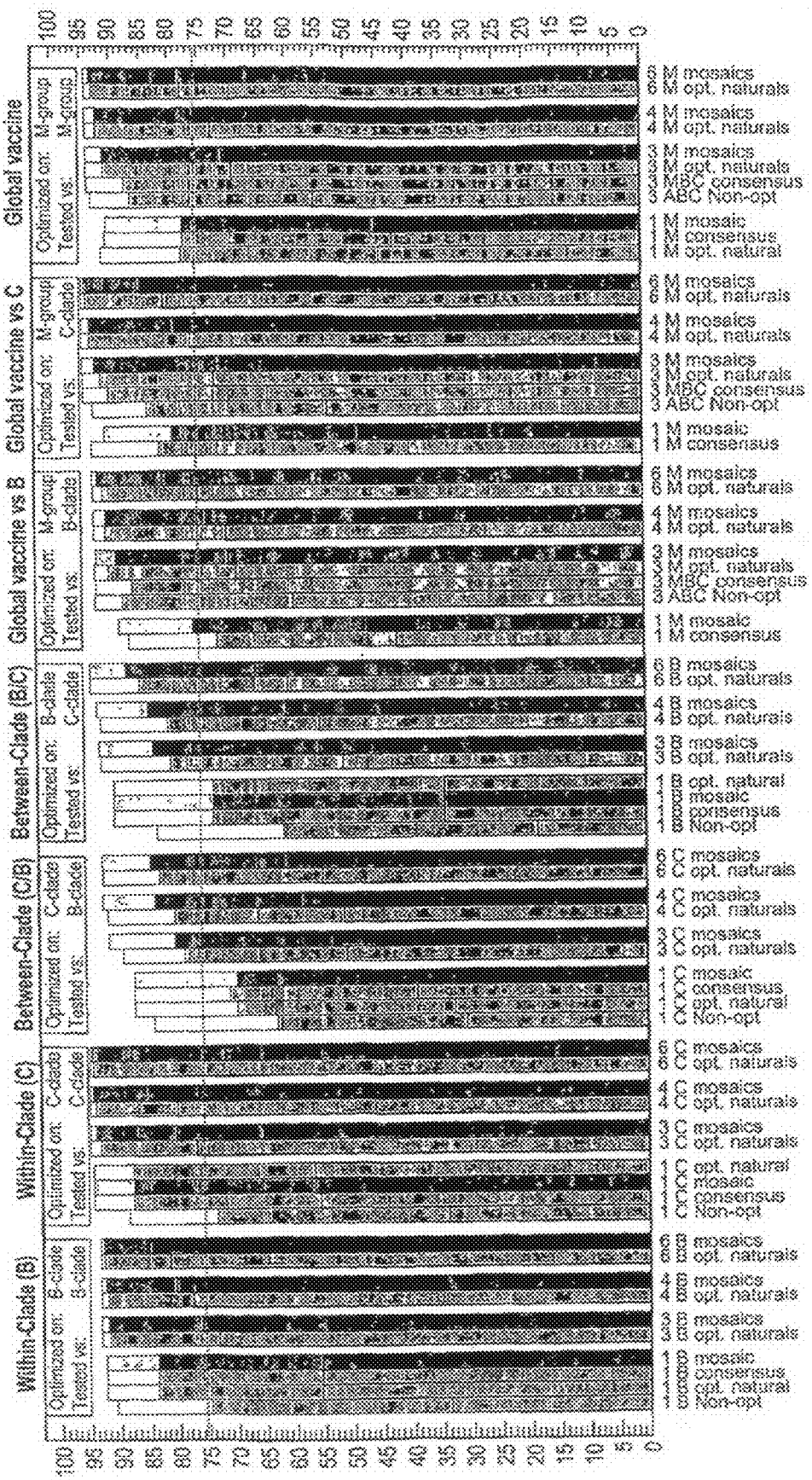

FIG. 5 summarizes total coverage for the different vaccine design strategies, from single proteins through combinations of mosaic proteins, and compares within-subtype optimization to M group optimization. The performance of a single mosaic is comparable to the best single natural strain or a consensus sequence. Although a single consensus sequence out-performs a single best natural strain, the optimized natural-sequence cocktail does better than the consensus cocktail: the consensus sequences are more similar to each other than are natural strains, and are therefore somewhat redundant. Including even just two mosaic variants, however, markedly increases coverage, and four and six mosaic proteins give progressively better coverage than polyvalent cocktails of natural or consensus strains. Within-subtype optimized mosaics perform best—with four mosaic antigens 80-85% of the 9-mers are perfectly matched—but between-subtype coverage of these sets falls off dramatically, to 50-60%. In contrast, mosaic proteins optimized using the full M group give coverage of approximately 75-80% for individual subtypes, comparable to the coverage of the M group as a whole (FIGS. 5 and 6). If imperfect 8/9 matches are allowed, both M group optimized and within-subtype optimized mosaics approach 90% coverage.

Figure 7A:
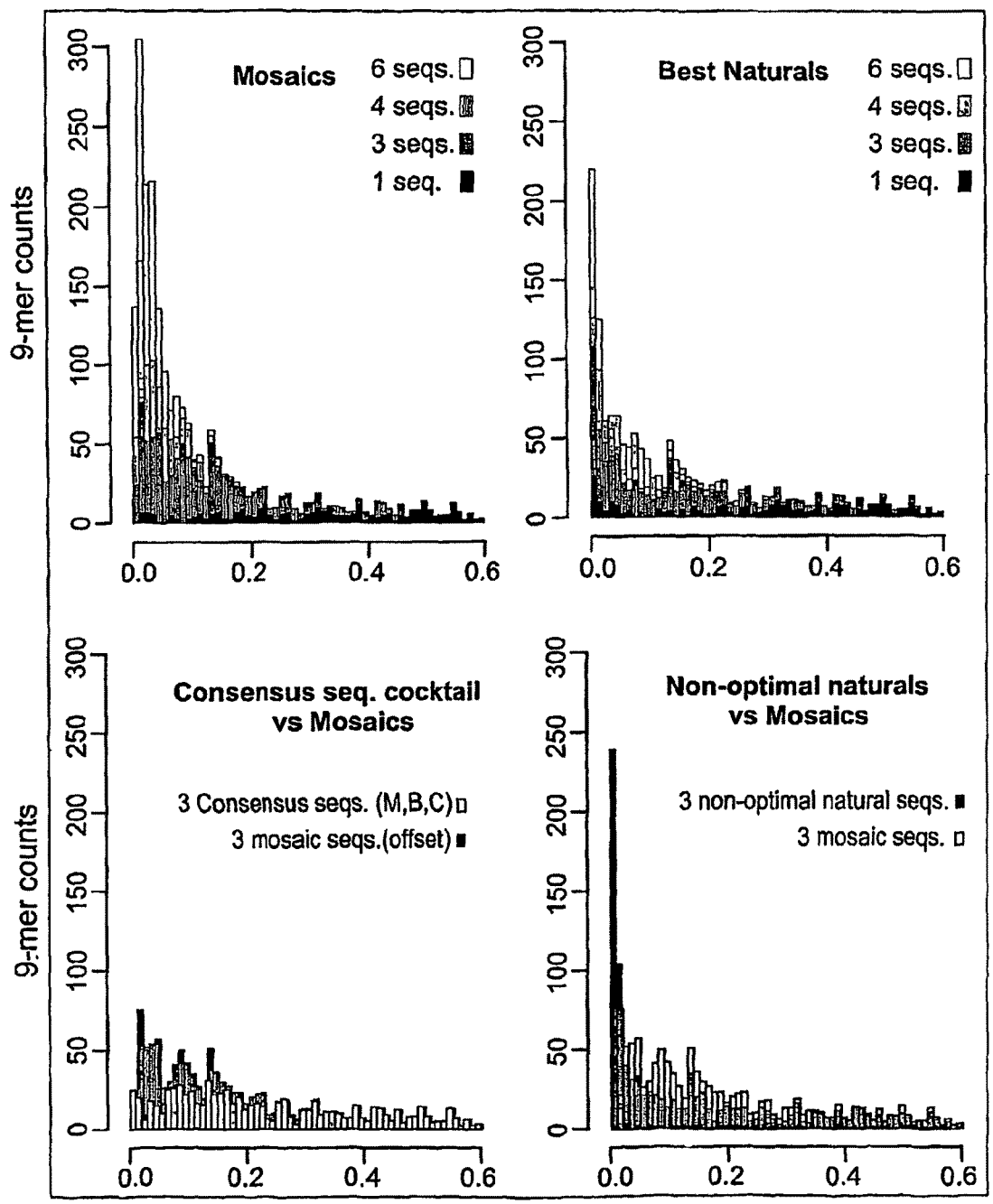
FIGS. 7A and 7B. The distribution of 9-mers by frequency of occurrence in natural, consensus, and mosaic sequences. Occurrence counts (y-axis) for different 9-mer frequencies (x-axis) for vaccine cocktails produced by several methods.
Figure 7B:
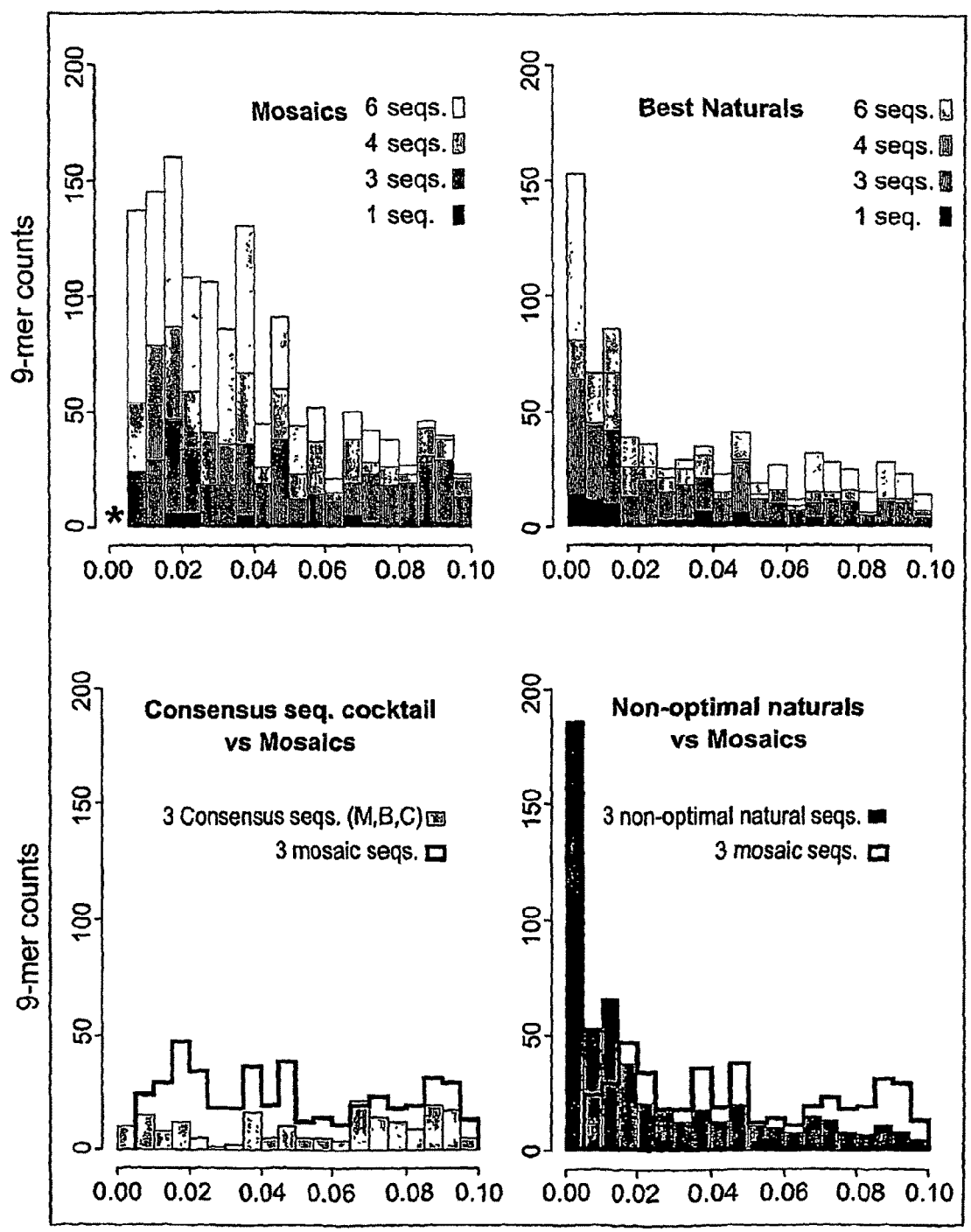

Since coverage is increased by adding progressively rarer 9-mers, and rare epitopes may be problematic (e.g., by inducing vaccine-specific immunodominant responses), an investigation was made of the frequency distribution of 9-mers in the vaccine constructs relative to the natural sequences from which they were generated. Most additional epitopes in a k=6 cocktail compared to a k=4 cocktail are low-frequency (<0.1, FIG. 7). Despite enhancing coverage, these epitopes are relatively rare, and thus responses they induce might draw away from vaccine responses to more common, thus more useful, epitopes. Natural-sequence cocktails actually have fewer occurrences of moderately low-frequency epitopes than mosaics, which accrue some lower frequency 9-mers as coverage is optimized. On the other hand, the mosaics exclude unique or very rare 9-mers, while natural strains generally contain 9-mers present in no other sequence. For example, natural M group Gag sequences had a median of 35 (range 0-148) unique 9-mers per sequence. Retention of HLA-anchor motifs was also explored, and anchor motif frequencies were found to be comparable between four mosaics and three natural strains. Natural antigens did exhibit an increase in number of motifs per antigen, possibly due to inclusion of strain-specific motifs (FIG. 8).

The increase in ever-rarer epitopes with increasing k, coupled with concerns about vaccination-point dilution and reagent development costs, resulted in the initial production of mosaic protein sets limited to 4 sequences (k=4), spanning Gag and the central region of Nef, optimized for subtype B, subtype C, and the M group (these sequences are included in FIG. 9; mosaic sets for Env and Pol are set forth in FIG. 10). Synthesis of various four-sequence Gag-Nef mosaics and initial antigenicity studies are underway. In the initial mosaic vaccine, targeted are just Gag and the center of the Nef protein, which are conserved enough to provide excellent global population coverage, and have the desirable properties described above in terms of natural responses (Bansal et al, Aids 19:241-50 (2005)). Additionally, including B subtype p24 variants in Elispot peptide mixtures to detect natural CTL responses to infection significantly enhanced both the number and the magnitude of responses detected supporting the idea that including variants of even the most conserved proteins will be useful. Finally, cocktails of proteins in a polyvalent HIV-1 vaccine given to rhesus macaques did not interfere with the development of robust responses to each antigen (Seaman et al, J. Virol. 79:2956-63 (2005)), and antigen cocktails did not produce antagonistic responses in murine models (Singh et al, J. Immunol. 169:6779-86 (2002)), indicating that antigenic mixtures are appropriate for T-cell vaccines.

Even with mosaics, variable proteins like Env have limited coverage of 9-mers, although mosaics improve coverage relative to natural strains. For example three M group natural proteins, one each selected from the A, B, and C clades, and currently under study for vaccine design (Seaman et al, J. Virol. 79:2956-63 (2005)) perfectly match only 39% of the 9-mers in M group proteins, and 65% have at least 8/9 matches. In contrast, three M group Env mosaics match 47% of 9-mers perfectly, and 70% have at least an 8/9 match. The code written to design polyvalent mosaic antigens is available, and could readily be applied to any input set of variable proteins, optimized for any desired number of antigens. The code also allows selection of optimal combinations of k natural strains, enabling rational selection of natural antigens for polyvalent vaccines. Included in Table 1 are the best natural strains for Gag and Nef population coverage of current database alignments.

---

Natural sequence cocktails having the best available 9-mer coverage for different genes, subtype sets, and numbers of sequences Gag, B-subtype, 1 natural sequence B.US.86.AD87_AF004394
Gag, B-subtype, 3 natural sequences B.US.86.AD87_AF004394
B.US.97.Ac_06_AY247251
B.US.88.WR27_AF286365
Gag, B-subtype, 4 natural sequences B.US.86.AD87_AF004394
B.US.97.Ac_06_AY247251
B.US._.R3_PDC1_AY206652
B.US.88.WR27_AF286365
Gag, B-subtype, 6 natural sequences B.CN._.CNHN24_AY180905
B.US.86.AD87_AF004394
B.US.97.Ac_06_AY247251
B.US._.P2_AY206654
B.US._.R3_PDC1_AY206652
B.US.88.WR27_AF286365
Gag, C-subtype, 1 natural sequence C.IN._.70177_AF533131
Gag, C-subtype, 3 natural sequences C.ZA.97.97ZA012
C.ZA.x.04ZASK161B1
C.IN.-.70177_AF533131
Gag, C-subtype, 4 natural sequences C.ZA.97.97ZA012
C.ZA.x.04ZASK142B1
C.ZA.x.04ZASK161B1
C.IN._.70177_AF533131
Gag, C-subtype, 6 natural sequences C.ZA.97.97ZA012
C.ZA.x.04ZASK142B1
C.ZA.x.04ZASK161B1
C.BW.99.99BWMC168_AF443087
C.IN._.70177_AF533131
C.IN._.MYA1_AF533139

-continued

Natural sequence cocktails having the best available 9-mer coverage for different genes, subtype sets, and numbers of sequences Gag, M-group, 1 natural sequence C.IN._.70177_AF533131
Gag, M-group, 3 natural sequences B.US.90.US2_AY173953
C.IN.-.70177_AF533131
15_01B.TH.99.99TH_R2399_AF530576
Gag, M-group, 4 natural sequences B.US.90.US2_AY173953
C.IN._.70177_AF533131
C.IN.93.93IN999_AF067154
15_01B.TH.99.99TH_R2399_AF530576
Gag, M-group, 6 natural sequences C.ZA.x.04ZASK138B1
B.US.90.US2_AY173953
B.US._.WT1_PDC1_AY206656
C.IN._.70177_AF533131
C.IN.93.93IN999_AF067154
15_01B.TH.99.99TH_R2399_AF530576
Nef (central region), B-subtype, 1 natural sequence B.GB.94.028jh_94_1_NP_AF129346
Nef (central region), B-subtype, 3 natural sequences B.GB.94.028jh_94_1_NP_AF129346
B.KR.96.96KCS4_AY121471
B.FR.83.HXB2_K03455
Nef (central region), B-subtype, 4 natural sequences B.GB.94.028jh_94_1_NP_AF129346
B.KR.96.96KCS4_AY121471
B.US.90.E90NEF_U43108
B.FR.83.HXB2_K03455
Nef (central region), B-subtype, 6 natural sequences B.GB.94.028jh_94_1_NP_AF129346
B.KR.02.02HYJ3_AY121454
B.KR.96.96KCS4_AY121471
B.CN._.RL42_U71182
B.US.90.E90NEF_U43108
B.FR.83.HXB2_K03455
Nef (central region), C-subtype, 1 natural sequence C.ZA.04.04ZASK139B1
Nef (central region), C-subtype, 3 natural sequences
C.ZA.04.04ZASK180B1
C.ZA.04.04ZASK139B1
C.ZA._.ZASW15_AF397568
Nef (central region), C-subtype, 4 natural sequences C.ZA.97.ZA97004_AF529682
C.ZA.04.04ZASK180B1
C.ZA.04.04ZASK139B1
C.ZA._.ZASW15_AF397568
Nef (central region), C-subtype, 6 natural sequences C.ZA.97.ZA97004_AF529682
C.ZA.00.1192M3M
C.ZA.04.04ZASK180B1
C.ZA.04.04ZASK139B1
C.04ZASK184B1
C.ZA._.ZASW15_AF397568
Nef (central region), M-group, 1 natural sequence B.GB.94.028jh_94_1_NP_AF129346
Nef (central region), M-group, 3 natural sequences 02_AG.CM._.98CM1390_AY265107
C.ZA.03.03ZASK020B2
B.GB.94.028jh_94_1_NP_AF129346
Nef (central region), M-group, 4 natural sequences 02_AG.CM._.98CM1390_AY265107
01A1.MM.99.mCSW105_AB097872

-continued

| Natural sequence cocktails having the best available 9-mer coverage for different genes, subtype sets, and numbers of sequences |
| --- |
| C.ZA.03.03ZASK020B2 |
| B.GB.94.028jh_94_1_NP_AF129346 |
| Nef (central region), M-group, 6 natural sequences |
| 02_AG.CM._.98CM1390_AY265107 |
| 01A1.MM.99.mCSW105_AB097872 |
| C.ZA.03.03ZASK020B2 |
| C.03ZASK111B1 |
| B.GB.94.028jh_94_1_NP_AF129346 |
| B.KR.01.01CWS2_AF462757 |

Summarizing, the above-described study focuses on the design of T-cell vaccine components to counter HIV diversity at the moment of infection, and to block viral escape routes and thereby minimize disease progression in infected individuals. The polyvalent mosaic protein strategy developed here for HIV-1 vaccine design could be applied to any variable protein, to other pathogens, and to other immunological problems. For example, incorporating a minimal number of variant peptides into T-cell response assays could markedly increase sensitivity without excessive cost: a set of k mosaic proteins provides the maximum coverage possible for k antigens.

A centralized (consensus or ancestral) gene and protein strategy has been proposed previously to address HIV diversity (Gaschen et al, Science 296:2354-2360 (2002)). Proof-of-concept for the use of artificial genes as immunogens has been demonstrated by the induction of both T and B cell responses to wild-type HIV-1 strains by group M consensus immunogens (Gaschen et al, Science 296:2354-2360 (2002), Gao et al, J. Virol. 79:1154-63 (2005), Doria-Rose et al, J. Virol. 79:11214-24 (2005), Weaver et al, J. Virol., in press)). The mosaic protein design improves on consensus or natural immunogen design by co-optimizing reagents for a polyclonal vaccine, excluding rare CD8+ T-cell epitopes, and incorporating variants that, by virtue of their frequency at the population level, are likely to be involved in escape pathways.

The mosaic antigens maximize the number of epitope-length variants that are present in a small, practical number of vaccine antigens. The decision was made to use multiple antigens that resemble native proteins, rather than linking sets of concatenated epitopes in a poly-epitope pseudo-protein (Hanke et al, Vaccine 16:426-35 (1998)), reasoning that in vivo processing of native-like vaccine antigens will more closely resemble processing in natural infection, and will also allow expanded coverage of overlapping epitopes. T-cell mosaic antigens would be best employed in the context of a strong polyvalent immune response; improvements in other areas of vaccine design and a combination of the best strategies, incorporating mosaic antigens to cover diversity, may ultimately enable an effective cross-reactive vaccine-induced immune response against HIV-1.

All documents and other information sources cited above are hereby incorporated in their entirety by reference.

SEQUENCE LISTING (168 sequences)

SEQ ID NO: 1 - protein, 85 aa, Human immunodeficiency virus 1
EVGFPVRPQVPLRPMTYKGALDLSHFLKEKGGLEGLIYSQKRQDILDLWVYHTQGYFPDWQNYTPGPGIRYPLTFGWCFKLVPVE

SEQ ID NO: 2 - protein, 85 aa, Human immunodeficiency virus 1
EVGFPVKPQVPLRPMTYKAAVDLSHFLKEKGGLEGLVYSQKRQDILDLWIYHTQGYFPDWQNYTPGPGTRFPLTFGWCFKLVPVD

SEQ ID NO: 3 - protein, 85 aa, Human immunodeficiency virus 1
EVGFPVTPQVPLRPMTYKGALDLSHFLREKGGLEGLIYSQKRQEILDLWVYHTQGYFPDWHNYTPGPGVRYPLTFGWCFKLVPVE

SEQ ID NO: 4 - protein, 85 aa, Human immunodeficiency virus 1
EVGFPVRPQVPLRPMTYKAALDLSHFLKEKGGLEGLIHSQRRQDILDLWVYHTQGFFPDWQNYTPGPGIRYPLTFGWCYKLVPVE

SEQ ID NO: 5 - protein, 85 aa, Human immunodeficiency virus 1
EVGFPVTPQVPLRPMTYKAAVDLSHFLREKGGLEGLIHSQKRQDILDLWIYHTQGYFPDWQNYTPGPGIRYPLTFGWCYKLVPVE

SEQ ID NO: 6 - protein, 85 aa, Human immunodeficiency virus 1
DVGFPVRPQIPLRPMTYKAALDLSHFLREKGGLEGLVYSQKRQDILDLWVYHTQGFFPDWQNYTPGPGTRFPLTFGWCFKLVPVD

SEQ ID NO: 7 - protein, 85 aa, Human immunodeficiency virus 1
EVGFPVRPQVPLRPMTYKGAVDLSHFLKEKGGLEGLIYSQKRQEILDLWVYHTQGYFPDWGNYTPGPGTRYPLTFGWCLKLVPVE

SEQ ID NO: 8 - protein, 85 aa, Human immunodeficiency virus 1
EVGFPVKPQVPLRPMTYKGALDLSHFLKEKGGLDGLIYSQRRQDILDLWVYNTQGYFPDWHNYTPGPGVRYPLTFGWCFKLVPVE

SEQ ID NO: 9 - protein, 85 aa, Human immunodeficiency virus 1
EVGFPIRPQVPLRPMTFKGALDLSHFLKEKGGLDGLIYSQKRQEILDLWVYHTQGYFPDWHNYTPGPGIRYPLCFGWCFKLVPVE

SEQ ID NO: 10 - protein, 85 aa, Human immunodeficiency virus 1
EVGFPVTPQVPLRPMTYKGAVDLSHFLKEQGGLEGLIYSQRRQDILDLWIYNTQGYFPDWQCYTPGPGVRFPLTFGWCFKLEPVD

SEQ ID NO: 11 - protein, 85 aa, Human immunodeficiency virus 1
EVGFPVKPQVPLRPMTYKAAVDLSHFLKEKGGLEGLIYSQKRQDILDLWIYHTQGYFPDWQNYTPGPGIRYPLTFGWCLKLVPVE

SEQ ID NO: 12 - protein, 85 aa, Human immunodeficiency virus 1
DVGFPVRPQVPLRPMTYKAALDLSHFLKEEGGLEGLIYSQQRQDILDLWVYHTQGFFPDWQNYTPGPGTRYPLTFGWCYKLVPVE

SEQ ID NO: 13 - protein, 85 aa, Human immunodeficiency virus 1
EVGFPVRPQIPLRPMTYKGALDLSHFLREKGGLEGLVYSQKRQDILDLWVHHTQGYFPDWGNYTPGPGTRFPLTFGWCFKLVPVD

SEQ ID NO: 14 - protein, 85 aa, Human immunodeficiency virus 1
EVGFPVRPQVPLRPMTYKGAFDLSHFLKDKGGLEGLIHSQKRQDILDLWVYNTQGYFPDWQNYTPGPGVRYPLTFGWCFKLVPLE

SEQ ID NO: 15 - protein, 85 aa, Human immunodeficiency virus 1
EVGFPVRPQVPLRPMTYKAAFDLSFFLKEKGGLEGLIYSKKRQEILDLWVYHTQGFFPDWQNYTPGPGVRYPLTFGWCFKLVPVD

SEQ ID NO: 16 - protein, 85 aa, Human immunodeficiency virus 1
EVGFPVTPQVPLRPMTFKGAFDLGFFLKEKGGLDGLIYSKKRQDILDLWVYHTQGYFPDWQNYTPGPGVRYPLTFGWCYKLVPVD

SEQ ID NO: 17 - protein, 85 aa, Human immunodeficiency virus 1
EVGFPVKPQVPLRPMTYKAAFDLSFFLKDKGGLEGLIWSKKRQEILDLWVYHTQGFFPDWQNYTPGPGIRYPLTFGWPFKLVPVD

SEQ ID NO: 18 - protein, 85 aa, Human immunodeficiency virus 1
EVGFPVRPQVPLRPMTYKGAFDLSFFLKEKGGLEGLIYSKKRQEILDLWVYNTQGFFPDWHNYTPGPGVRFPLTFGWCFKLVPVD

SEQ ID NO: 19 - protein, 85 aa, Human immunodeficiency virus 1
EVGFPVRPQVPLRPMTYKGAFDLSFFLKEKGGLEGLIWSKKRQEILDLWVYNTQGYFPDWQCYTPGPGVRFPLTFGWCFKLVPVD

SEQ ID NO: 20 - protein, 85 aa, Human immunodeficiency virus 1
DVGFPVRPQVPVRPMTYKAAFDLSFFLKDKGGLEGLIHSKRRQDILDLWVYNTQGFFPDWHNYTPGPGIRYPLTFGWCFKLVPVD

SEQ ID NO: 21 - protein, 85 aa, Human immunodeficiency virus 1
EVGFPVKPQVPLRPMTYKAAVDLSFFLKEKGGLEGLIYSKKRQEILDLWVYHTQGFFPDWQNYTPGPGTRYPLTFGWPFKLVPVD

SEQ ID NO: 22 - protein, 85 aa, Human immunodeficiency virus 1; identical to SEQ ID NO: 16

SEQ ID NO: 23 - protein, 85 aa, Human immunodeficiency virus 1
DVGFPVRPQVPLRPMTYKGAFDLSFFLKEKGGLDGLIYSKKRQEILDLWVYNTQGYFPDWQCYTPGPGVRYPLTFGWCYKLVPVD

SEQ ID NO: 24 - protein, 85 aa, Human immunodeficiency virus 1
EVGFPVKPQVPVRPMTYKAAFDLSFFLKDKGGLEGLIWSKKRQEILDLWVYHTQGFFPDWQNYTPGPGIRYPLTFGWCFKLVPVD

SEQ ID NO: 25 - protein, 85 aa, Human immunodeficiency virus 1
EVGFPVKPQVPLRPMTFKGAFDLGFFLKEKGGLEGLIYSKQRQDILDLWVYHTQGFFPDWHNYTPGPGVRLPLTFGWCFKLVPVD

SEQ ID NO: 26 - protein, 85 aa, Human immunodeficiency virus 1
GVGFPVRPQVPVRPMTYKAAFDLGFFLKDKGGLEGLIYSKKRQDILDLWVYNTQGFFPDWQNYTPGPGVRFPLTFGWCFKLVPVD

SEQ ID NO: 27 - protein, 85 aa, Human immunodeficiency virus 1
EVGFPVTPQVPLRPMTYKAAVDLSWFLKEKGGLDGLIYSRKRQEILDLWVHHTQGFFPDWQNYTPGPGTRFPLTFGWCFKLVPVD

SEQ ID NO: 28 - protein, 85 aa, Human immunodeficiency virus 1
EVGFPVRPQVPVRPMTYKGAVDLSFFLKEKGGLEGLIHSKRRQDILDLWVYHTQGYFPDWQNYTPGPGTRYPLTFGWPFKLVPVD

SEQ ID NO: 29 - protein, 85 aa, Human immunodeficiency virus 1
EVGFPVRPQVPLRPMTYKGALDLSHFLKEKGGLEGLIYSKKRQEILDLWVYHTQGYFPDWQNYTPGPGVRYPLTFGWCFKLVPVD

SEQ ID NO: 30 - protein, 85 aa, Human immunodeficiency virus 1
DVGFPVRPQVPLRPMTYKAAVDLSHFLKEKGGLEGLVYSQKRQDILDLWVYHTQGFFPDWQNYTPGPGVRYPLTFGWCYKLVPVD

SEQ ID NO: 31 - protein, 85 aa, Human immunodeficiency virus 1
EVGFPVRPQVPVRPMTYKGAFDLSFFLKEKGGLEGLIYSKKRQEILDLWVYHTQGYFPDWHNYTPGPGTRFPLTFGWCFKLVPVD

SEQ ID NO: 32 - protein, 85 aa, Human immunodeficiency virus 1
EVGFPVKPQVPLRPMTYKGALDLSHFLKEKGGLDGLIYSKKRQDILDLWVYNTQGYFPDWQNYTPGPGIRYPLTFGWCFKLVPVE

SEQ ID NO: 33 - protein, 85 aa, Human immunodeficiency virus 1
EVGFPVTPQVPLRPMTFKGAFDLGFFLKEKGGLEGLIYSKKRQEILDLWVYHTQGFFPDWQNYTPGPGTRYPLCFGWCFKLVPVE

SEQ ID NO: 34 - protein, 85 aa, Human immunodeficiency virus 1
EVGFPVKPQVPLRPMTYKAAVDLSHFLKEKGGLEGLVYSQKRQDILDLWVYHTQGYFPDWQNYTPGPGIRYPLTFGWCYKLVPVD

SEQ ID NO: 35 - protein, 85 aa, Human immunodeficiency virus 1
DVGFPVRPQVPLRPMTYKGALDLSHFLKEEGGLEGLIYSQKRQEILDLWVYNTQGYFPDWQNYTPGPGVRYPLTFGWCFKLVPVD

SEQ ID NO: 36 - protein, 85 aa, Human immunodeficiency virus 1
EVGFPVRPQVPVRPMTYKGAFDLSFFLKEKGGLDGLIYSKKRQDILDLWVYNTQGFFPDWHNYTPGPGTRFPLTFGWCFELVPVD

SEQ ID NO: 37 - protein, 85 aa, Human immunodeficiency virus 1
EVGFPVRPQVPTRPMTYKGAVDLSHFLKEKGGLEGLVYSQKRQDILDLWVHHTQGFFPDWQNYTPGPGTRYPLTFGWPFKLVPVD

SEQ ID NO: 38 - protein, 85 aa, Human immunodeficiency virus 1
DVGFPVRPQVPVRPMTYKAAFDLSFFLREKGGLDGLIYSKKRQDILDLWVYNTQGYFPDWQNYTPGPGVRFPLTFGWCFELVPVD

SEQ ID NO: 39 - protein, 85 aa, Human immunodeficiency virus 1
NVGFPVRPQVPLRPMTFKGAFDLGFFLKEKGGLEGLIYSKKRQEILDLWVYHTQGYFPDWHNYTPGPGTRFPLTFGWCFKLVPVE

SEQ ID NO: 40 - protein, 85 aa, Human immunodeficiency virus 1
EVGFPVTPQVPLRPMTYKGAFDLSFFLKEKGGLDGLIYSRKRQEILDLWVYNTQGFFPDWQNYTPGPGIRYPLTFGWCFKLVPMD

SEQ ID NO: 41 - protein, 85 aa, Human immunodeficiency virus 1
EVGFPVKPQVPLRPMTYKAAVDLSHFLREKGGLEGLIHSQRRQDILDLWIYHTQGYFPDWQCYTPGPGVRYPLTFGWCYKLVPVD

SEQ ID NO: 42 - protein, 85 aa, Human immunodeficiency virus 1
GVGFPVRPQIPLRPMTYKGALDLSHFLKEEGGLEGLIYSQKRQDILDLWVYHTQGFFPDWHNYTPGPGIRYPLCFGWCFKLVPVD

SEQ ID NO: 43 - protein, 500 aa, Human immunodeficiency virus 1
MGARASVLSGGELDRWEKIRLRPGGKKKYKLKHIVWASRELERFAVNPGLLETSEGCRQILGQLQPSLQTGSEELRSLYNTVATLYCVHQRIEVKDTKEALDKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQ

SEQ ID NO: 44 - protein, 500 aa, Human immunodeficiency virus 1
MGARASILSGGELDRWEKIRLRPGGKKQYRLKHIVWASRELERFAINPGLLETSDGCRQILGQLQPALQTGSEELKSLFNTVATLYCVHQRIDVKDTKEALDKIEEEQNKSKKKAQQAAADTGNSSQVSQNYPIVQNIQGQMVHQAISPRTLNAWVKVIEEKAFSPEVIPMFSALSEGATPQDLNTMLNTVGGHQAAMQMLKETINEEAADWDRLHPVHAGPIAPGQMREPRGSDIAGTTSTLQEQIGWMTNNPPIPVGEIYKRWIIMGLNKIVRMYSPSSILDIKQGPKEPFRDYVDRFYKVLRAEQASQEVKNWMTETLLVQNSNPDCKTILKALGPGATLEEMMTACQGVGGPGHKARVLAEAMSQMTNSATIMMQKGNFRNQRKPVKCFNCGKEGHIAKNCRAPRKKGCWKCGREGHQMKDCTERQANFLGKIWPSYKGRPGNFLQNRPEPTAPPAESFRFGEETTTPSQKQETIDKELYPLASLRSLFGSDPSSQ

SEQ ID NO: 45 - protein, 500 aa, Human immunodeficiency virus 1
MGARASVLSGGQLDRWEKIRLRPGGKKKYRLKHLVWASRELERFAVNPGLLETAEGCRQILEQLQPSLQTGSEELRSLFNTVAVLYCVHQRIEVKDTKEALDKVEEEQNKSKKKAQQTAADTGNNSQVSQNYPIVQNMQGQMVHQALSPRTLNAWVKVIEEKAFSPEVIPMFTALSEGATPQDLNTMLNTVGGHQAAMQMLKDTINEEAAEWDRLHPVQAGPVAPGQIREPRGSDIAGSTSTLQEQIGWMTSNPPIPVGEIYKRWIILGLNKIVRMYSPVSILDIRQGPKEPFRDYVDRFYKTLRAEQATQEVKNWMTETLLVQNANPDCKTILKALGPGATLEEMMTACQGVGGPSHKARVLAEAMSQVTNSATIMMQRGNFRNQRKIVKCFNCGKEGHIARNCRAPRKRGCWKCGKEGHQMKDCNERQANFLGKIWPSHKGRPGNFLQSRPEPSAPPEESFRFGEEKTTPSQKQEPIDKDLYPLASLKSLFGNDPSLQ

SEQ ID NO: 46 - protein, 500 aa, Human immunodeficiency virus 1
MGARASVLSGGELDKWEKIRLRPGGKKKYKLKHIVWASRELERFAVNPGLLETSEGCRQILGQLQPSLQTGSEELRSLYNTVATLYCVHQKIEVKDTKEALEKIEEEQNKCKKKAQQAAAGTGNSSQVSQNYPIVQNLQGQMVHQPISPRTLNAWVKVVEEKAFSPEVIPMFSALAEGATPQDLNTMLNTVGGHQAAMQMLKETINEEAAEWDRLHPVHAGPVAPGQMRDPRGSDIAGTTSNLQEQIGWMTHNPPIPVGDIYKRWIILGLNKIVRMYSPTSILDIRQGPKESFRDYVDRFYKTLRAEQASQDVKNWMTETLLVQNANPDCRTILKALGPAATLEEMMTACQGVGGPSHKARILAEAMSQVTNPATIMMQRGNFRNQRKTVKCFNCGKEGHLARNCRAPRKKGCWKCGKEGHQMKECTERQANFLGKIWPSHKGRPGNFLQSRPEPTAPPEESFRFGEETATPPQKQEPIDKELYPLTSLRSLFGNDPSSQ

SEQ ID NO: 47 - protein, 500 aa, Human immunodeficiency virus 1
MGARASVLSGGQLDRWEKIRLRPGGKKKYRLKHLVWASRELERFAVNPGLLETAEGCRQILEQLQPSLQTGSEELRSLFNTVATLYCVHQRIDVKDTKEALDKIEEEQNKCKKKAQQAAADTGNSSQVSQNYPIVQNIQGQMVHQALSPRTLNAWVKVVEEKAFSPEVIPMFTALSEGATPQDLNTMLNTVGGHQAAMQMLKETINEEAAEWDRLHPVQAGPVAPGQMREPRGSDIAGSTSTLQEQIGWMTNNPPIPVGDIYKRWIILGLNKIVRMYSPVSILDIRQGPKESFRDYVDRFYKVLRAEQASQEVKNWMTETLLVQNANPDCRTILKALGPAATLEEMMTACQGVGGPGHKARVLAEAMSQMTNSATIMMQRGNFRNQRKTVKCFNCGKEGHIAKNCRAPRKKGCWKCGKEGHQMKECTERQANFLGKIWPSYKGRPGNFLQSRPEPSAPPAESFRFGEETTTPSQKQETIDKELYPLTSLRSLFGNDPSLQ

SEQ ID NO: 48 - protein, 500 aa, Human immunodeficiency virus 1
MGARASVLSGGELDKWEKIRLRPGGKKKYKLKHIVWASRELERFAINPGLLETSEGCRQILGQLQPALQTGSEELRSLYNTVATLYCVHQKIEVKDTKEALEKVEEEQNKSKQKAQQAAADTGNNSQVSQNYPIVQNLQGQMVHQAISPRTLNAWVKVIEEKAFSPEVIPMFAALSEGATPQDLNTMLNTVGGHQAAMQMLKETINEEAADWDRLHPVHAGPIAPGQIREPRGSDIAGTTSNLQEQIAWMTNNPPIPVGEIYKRWIIMGLNKIVRMYSPTSILDIKQGPKEPFRDYVDRFYRTLRAEQASQDVKNWMTETLLVQNANPDCRTILKALGPGATLEEMMTACQGVGGPSHKARVLAEAMSQVTNPATIMMQRGNFRNQRKPVKCFNCGKEGHLAKNCRAPRKRGCWKCGKEGHQMKDCNERQANFLGKIWPSHKGRPGNFLQNRPEPSAPPEESFRFGEETATPSQKQEPIDKELYPLASLRSLFGSDPSSQ

SEQ ID NO: 49 - protein, 500 aa, Human immunodeficiency virus 1
MGARASILSGGELDRWEKIRLRPGGKKQYRLKHIVWASRELERFAVNPGLLETSEGCKQILEQLQPALQTGSEELKSLYNTVAVLYCVHQRIEIKDTKEALEKIEEEQNKSKKKAQQTAADTGNNSQVSQNYPIVQNLQGQMVHQPISPRTLNAWVKVIEEKAFSPEVIPMFSALAEGATPQDLNTMLNTVGGHQAAMQMLKETINEEAAEWDRLHPVHAGPVAPGQMRDPRGSDIAGTTSNLQEQIGWMTSNPPIPVGEIYKRWIILGLNKIVRMYSPTSILDIRQGPKEPFRDYVDRFYKTLRAEQATQEVKNWMTETLLVQNANPDCKTILKALGPGATLEEMMTACQGVGGPSHKARILAEAMSQVTNSATVMMQRGNFRNQRKTIKCFNCGKEGHLARNCRAPRKKGCWKCGREGHQMKDCTERQANFLGKIWPSYKGRPGNFLQNRPEPTAPPAESFRFGEETTTPPQKQEPIDKELYPLASLKSLFGNDPSSQ

SEQ ID NO: 50 - protein, 500 aa, Human immunodeficiency virus 1
MGARASVLSGGKLDKWEKIRLRPGGKKKYQLKHIVWASRELERFALNPGLLETSDGCRQILGQLQPSLQTGSEELKSLFNTVAVLYCVHQRIEVKDTKEALDKVEEEQNKSKKKAQQAAAGTGNSSQVSQNYPIVQNMQGQMVHQALSPRTLNAWVKVIEEKAFSPEVIPMFSALSEGATPQDLNTMLNTVGGHQAAMQMLKDTINEEAAEWDRVHPVHAGPIAPGQMREPRGSDIAGTTSTLQEQIGWMTHNPPIPVGEIYKRWIILGLNKIVRMYSPSSILDIRQGPKEPFRDYVDRFYKTLRAEQASQEVKNWMTETLLVQNSNPDCKTILKALGPAATLEEMMTACQGVGGPSHKARVLAEAMSQVTNSATIMMQKGNFRNQRKIVKCFNCGKEGHIARNCRAPRKKGCWRCGKEGHQMKDCTERQVNFLGKIWPSYKGRPGNFLQSRPEPTAPPEESFRFGEEKTTPSQKQEPIDKDLYPLASLKSLFGNDPLSQ

SEQ ID NO: 51 - protein, 500 aa, Human immunodeficiency virus 1
MGARASILSGGELDRWEKIRLRPGGSKKYRLKHIVWASRELERFAVNPGLLETAEGCRQILGQLQPSLQTGSEELRSLYNTIATLYCVHQRIEIKDTKEALEKIEEEQNKSKKKAQQTAADTGNNSQVSQNYPIVQNLQGQMVHQPISPRTLNAWVKVVEEKAFSPEVIPMFSALAEGATPQDLNTMLNTVGGHQAAMQMLKETINEEAAEWDRLHPVHAGPVAPGQIREPRGSDIAGTTSNLQEQIGWMTSNPPIPVGEIYKRWIILGLNKIVRMYSPISILDIRQGPKEPFRDYVDRFYRTLRAEQASQDVKNWMTETLLVQNANPDCKTILKALGPGATLEEMMTACQGVGGPGHKARVLAEAMSQVTNSATVMMQRGNFRNQRRTVKCFNCGKEGHIARNCRAPRKKGCWKCGQEGHQMKDCTERQANFLGKIWPSYKGRPGNFLQSRPEPTAPPAESFRFGEETTTPPQKQEPIDKELYPLTSLKSLFGNDPSSQ

SEQ ID NO: 52 - protein, 500 aa, Human immunodeficiency virus 1
MGARASVLSGGKLDRWEKIRLRPGGKKKYRLKHVVWASRELERFAVNPGLLESSEGCRQILEQLQPSLQTGSEELRSLFNTVATLYCVHQRIDVKDTKEALDKIEEEQNKCKKKAQQAAADTGNNSQVSQNYPIVQNLQGQMVHQPISPRTLNAWVKVVEEKAFSPEVIPMFAALSEGATPQDLNTMLNTVGGHQAAMQMLKETINEEAAEWDRVHPVHAGPIAPGQMREPRGSDIAGSTSTLQEQIGWMTNNPPIPVGDIYKRWIILGLNKIVRMYSPASILDIRQGPKEPFRDYVDRFYKTLRAEQATQEVKNWMTETLLVQNANPDCRTILKALGPGATLEEMMTACQGVGGPGHKARVLAEAMSQMTNSATIMMQKGNFRNQRKTIKCFNCGKEGHIARNCKAPRKKGCWKCGREGHQMKDCIERQANFLGKIWPSHKGRPGNFLQNRPEPTAPPEESFRFGEETATPPQKQEPIDKELYPLASLKSLFGSDPSSQ

SEQ ID NO: 53 - protein, 500 aa, Human immunodeficiency virus 1
MGARASVLSGGELDRWEKIRLRPGGKKKYRLKHLVWASRELERFAVNPGLLETSDGCRQILGQLQPALQTGSEELKSLYNTVATLYCVHQKIDVRDTKEALDKIEEEQNKSKQKAQQAAADTGNSSQVSQNYPIVQNIQGQMVHQAISPRTLNAWVKVVEEKAFSPEVIPMFTALSEGATPQDLNTMLNTVGGHQAAMQMLKETINEEAAEWDRLHPVQAGPVAPGQMREPRGSDIAGTTSTLQEQIGWMTHNPPIPVGEIYKRWIIMGLNKIVRMYSPSSILDIRQGPKESFRDYVDRFYKVLRAEQASQEVKNWMTETLLVQNANPDCKTILKALGPGATLEEMMTACQGVGGPSHKARVLAEAMSQVTNSATIMMQRGNFRNQRKTVKCFNCGKEGHIAKNCRAPRKRGCWKCGKEGHQMKECTERQANFLGKIWPSHKGRPGNFLQSRPEPTAPPEESFRFGEEKTTPSQKQETIDKELYPLASLRSLFGNDPSSQ

SEQ ID NO: 54 - protein, 500 aa, Human immunodeficiency virus 1
MGARASVLSGGELDKWEKIRLRPGGKKKYQLKHIVWASRELERFAVNPGLLETSEGCKQILEQLQPALQTGSEELRSLYNTIAVLYCVHQKIEIKDTKEALDKVEEEQNKSKKKAQQAAAGTGNSSQVSQNYPIVQNLQGQMVHQPLSPRTLNAWVKVVEEKAFSPEVIPMFTALSEGATPQDLNTMLNTVGGHQAAMQMLKETINEEAADWDRLHPVHAGPIAPGQMREPRGSDIAGSTSTLQEQIGWMTHNPPIPVGDIYKRWIILGLNKIVRMYSPTSILDIKQGPKEPFRDYVDRFYKTLRAEQATQEVKNWMTETLLVQNANPDCRTILKALGPAATLEEMMTACQGVGGPSHKARILAEAMSQVTNPATIMMQRGNFRNQRKPVKCFNCGKEGHIARNCRAPRKRGCWKCGKEGHQMKDCTERQVNFLGKIWPSHKGRPGNFLQNRPEPSAPPAESFRFGEETTTPSQKQEPIDKEMYPLASLRSLFGSDPSSQ

SEQ ID NO: 55 - protein, 500 aa, Human immunodeficiency virus 1
MGARASVLSGGQLDRWEKIRLRPGGKKQYRLKHIVWASRELERFAINPGLLETSEGCRQILGQLQPSLQTGSEELKSLFNTVAVLYCVHQRIEVKDTKEALEKVEEEQNKSKKKAQQAAADTGNSSQVSQNYPIVQNLQGQMVHQALSPRTLNAWVKVIEEKAFSPEVIPMFSALSEGATPQDLNTMLNTVGGHQAAMQMLKDTINEEAAEWDRLHPVHAGPVAPGQMRDPRGSDIAGTTSTLQEQIAWMTNNPPIPVGEIYKRWIILGLNKIVRMYSPTSILDIRQGPKEPFRDYVDRFYKVLRAEQASQDVKNWMTETLLVQNANPDCKTILKALGPAATLEEMMTACQGVGGPGHKARVLAEAMSQVTNSTTIMMQRGNFRNQRKIVKCFNCGKEGHLAKNCRAPRKKGCWKCGKEGHQMKECTERQANFLGKIWPSHKGRPGNFLQSRPEPSAPPEESFRFGEETATPSQKQEPIDKDLYPLASLKSLFGNDPLSQ

SEQ ID NO: 56 - protein, 500 aa, Human immunodeficiency virus 1
MGARASVLSGGKLDKWEKIRLRPGGKKKYKLKHIVWASRELERFALNPGLLETSEGCRQILRQLQPSLQTGSEELRSLYNTVATLYCVHQKIEVKDTKEALEKIEEEQNKSKKKAQQTAADTGNNSQVSQNYPIVQNMQGQMVHQALSPRTLNAWVKVVEEKAFSPEVIPMFSALSEGATPQDLNTMLNTVGGHQAAMQMLKDTINEEAAEWDRLHPAQAGPIAPGQIREPRGSDIAGTTSNLQEQIAWMTHNPPIPVGDIYKRWIILGLNKIVRMYSPVSILDIRQGPKEPFRDYVDRFYKTLRAEQASQEVKNWMTETLLVQNSNPDCKTILKALGPGATLEEMMTACQGVGGPGHKARVLAEAMSQVTNPATIMMQKGNFKNQRKTVKCFNCGKEGHLARNCRAPRKKGCWRCGKEGHQMKDCNERQANFLGKIWPSHKGRPGNFLQSRPEPTAPPEESFRFGEETTTPAQKQEPIDKELYPLTSLRSLFGNDPSLQ

SEQ ID NO: 57 - protein, 499 aa, Human immunodeficiency virus 1
MGARASILRGGKLDKWEKIRLRPGGKKHYMLKHLVWASRELERFALNPGLLETSEGCKQIIKQLQPALQTGTEELRSLYNTVATLYCVHEKIEVRDTKEALDKIEEEQNKSQQKTQQAKAADGKVSQNYPIVQNLQGQMVHQAISPRTLNAWVKVIEEKAFSPEVIPMFTALSEGATPQDLNTMLNTVGGHQAAMQMLKDTINEEAAEWDRLHPVHAGPIAPGQMREPRGSDIAGTTSTLQEQIAWMTSNPPIPVGDIYKRWIILGLNKIVRMYSPVSILDIKQGPKEPFRDYVDRFFKTLRAEQATQDVKNWMTDTLLVQNANPDCKTILRALGPGATLEEMMTACQGVGGPSHKARVLAEAMSQANNTNIMMQRSNFKGSKRIVKCFNCGKEGHIARNCRAPRKKGCWKCGKEGHQMKDCTERQANFLGKIWPSHKGRPGNFLQSRPEPTAPPAEPTAPPAESFRFEETTPAPKQEPKDREPLTSLKSLFGSDPLSQ

SEQ ID NO: 58 - protein, 506 aa, Human immunodeficiency virus 1
MGARASVLRGEKLDKWERIRLRPGGKKHYMLKHLVWASRELERFALNPSLLETSEGCKQIIQQLQPALKTGTEELRSLFNTVATLYCVHAGIEVRDTKEALDKIEEEQNKCQQKTQQAKEADGKVSQNYPIVQNLQGQMVHQALSPRTLNAWVKVIEEKAFSPEVIPMFTALSEGATPSDLNTMLNTVGGHQAAMQMLKDTINEEAAEWDRLHPVQAGPVAPGQMREPRGSDIAGTTSNLQEQIAWMTGNPPVPVGDIYKRWIILGLNKIVRMYSPVSILDIRQGPKEPFRDYVDRFFKTLRAEQSTQEVKNWMTETLLVQNANPDCKTILRALGPAASLEEMMTACQGVGGPSHKARVLAEAMSQANSTNIMMQRGNFKGPKRIIKCFNCGKEGHLARNCRAPRKKGCWKCGKEGHQMKDCIERQANFLGKIWPSNKGRPGNFLQNRPEPTAPPVEPTAPPAEPTAPPAESFKFEETTPAPKQEPKDREPLTSLRSLFGSDPLSQ

SEQ ID NO: 59 - protein, 492 aa, Human immunodeficiency virus 1
MGARASILRGEKLDTWEKIRLRPGGRKHYMLKHIVWASRELEKFALNPGLLETSEGCKQIMKQLQPALQTGTEELKSLYNTVATLYCVHEKIEVRDTKEAVDKIEEEQNKSQQKTQQAKAADEKVSQNYPIVQNIQGQMVHQPISPRTLNAWVKVIEEKGFNPEVIPMFTALSEGATPQDLNTMLNTVGGHQAAMQMLKDTINDEAAEWDRLHPVHAGPIAPGQMREPRGSDIAGSTSTLQEQITWMTSNPPVPVGEIYKRWIILGLNKIVRMYSPVSILDIKQGPKEPFRDYVDRFFKVLRAEQATQDVKNWMTDTLLIQNANPDCKTILKALGPGASLEEMMTACQGVGGPGHKARVLAEAMSQANNTNIMMQRSNFKGPKRIVKCFNCGKEGHIAKNCRAPRKKGCWKCGQEGHQMKDCTERQANFLGKIWPSQKGRPGNFLQNRPEPSAPPAESFRFGETTPAPKQELKDREPLTSLKSLFGSDPLSQ

SEQ ID NO: 60 - protein, 491 aa, Human immunodeficiency virus 1
MGARASILRGGKLDKWEKIRLRPGGKKRYMLKHLIWASRELERFALNPGLLETAEGCKQIIKQLQPALQTGTEELRSLYNTVATLYCVHKRIDVRDTKEALDKIEEEQNKIQQKTQQAKAADGKVSQNYPIVQNAQGQMVHQAISPRTLNAWVKVVEEKAFSPEIIPMFTALSEGATPQDLNSMLNAVGGHQAAMQMLKDTINEEAAEWDRVHPVHAGPVAPGQIREPRGSDIAGTTSTLQEQIAWMTSNPPIPVGDIYKRWIIMGLNKIVRMYSPVSILDIKQGPKESFRDYVDRFFKTLRAEQATQEVKNWMTDTLLVQNANPDCKTILRALGPGATLEEMMTACQGVGGPSHKARVLAEAMSQTNSAILMQRSNFKGSKRIVKCFNCGKEGHIARNCRAPRKRGCWKCGKEGHQMKECTERQANFLGKIWPSHKGRPGNFLQSRPEPTAPPAESFRFEETTPAPKQESKDREPLISLKSLFGNDPLSQ

SEQ ID NO: 61 - protein, 497 aa, Human immunodeficiency virus 1
MGARASVLRGEKLDTWERIKLRPGGKKHYMIKHLVWASRELEKFALNPGLLETSEGCKQIIQQLQPALKTGTEELKSLYNTVATLYCVHERIDVRDTKEALDKIEEEQNKIQQKTQQAKEADGKVSQNYPIVQNAQGQMVHQALSPRTLNAWVKVVEEKAFSPEIIPMFTALSEGATPSDLNTMLNTIGGHQAAMQMLKDTINDEAAEWDRLHPVHAGPIAPGQIREPRGSDIAGTTSTLQEQITWMTSNPPVPVGEIYKRWIILGLNKIVRMYSPVSILDIKQGPKESFRDYVDRFFKTLRAEQSTQEVKNWMTETLLVQNANPDCKTILKALGPGATLEEMMTACQGVGGPGHKARVLAEAMSQTNSAILMQRSNFKGSKRIVKCFNCGREGHIARNCKAPRKKGCWKCGKEGHQMKDCIERQANFLGKIWPSHKGRPGNFLQNRPEPTAPPEPTAPPAESFRFGETTPAPKQEQKDREPLISLKSLFGSDPLLQ

SEQ ID NO: 62 - protein, 492 aa, Human immunodeficiency virus 1
MGARASILRGEKLDKWERIRLRPGGKKHYMLKHLVWASRELDRFALNPGLLETSDGCKQIIKQLHPALQTGTEELRSLFNTVATLYCVHAGIEVRDTKEAVDKIEEEQNKSQQKTQQAKAADEKVSQNYPIVQNIQGQMVHQPISPRTLNAWVKVIEEKAFSPEVIPMFTALSDGATPQDLNTMLNTVGGHQAAMQMLKDTINEEAAEWDRIHPVHAGPVAPGQMRDPRGSDIAGSTSTLQEQIAWMTNNPPVPVGDIYKRWIIMGLNKIVRMYSPVSILDIRQGPKEPFRDYVDRFFRTLRAEQATQDVKNWMTDTLLIQNANPDCKTILRALGPGASLEEMMTACQGVGGPGHKARVLAEAMSQANNTNIMMQKSNFKGPKRTVKCFNCGKEGHIARNCRAPRKRGCWKCGKEGHQMKECTERQANFLGKIWPSQKGRPGNFLQSRPEPSAPPAESFRFEETTPAPKQESKDREPLTSLKSLFGSDPSSQ

SEQ ID NO: 63 - protein, 492 aa, Human immunodeficiency virus 1
MGARASILRGGKLDTWEKIRLRPGGKKRYMLKHLIWASRELERFALNPSLLETSEGCKQIMKQLQPALQTGTEELRSLYNTVATLYCVHKGIKVQDTKEALDKIEEEQKKSQQKTQQAEAADKGKVSQNYPIVQNLQGQMVHQPLSPRTLNAWVKVIERKAFSPEVIPMFSALSEGATPQDLNSMLNAVGGHQAAMQMLKDTINEEAAEWDRVHPVHAGPIAPGQMREPRGSDIAGTTSNLQEQIAWMTSNPPIPVGDIYKRWIVLGLNKIVRMYSPVSILDIKQGPKEPFRDYVDRFFKTLRAEQATQEVKNWMTDTLLVQNANPDCKTILRALGPAASLEEMMTACQGVGGPGHKARVLAEAMSQANSNIMMQRGNFKGPKRIIKCFNCGKEGHLARNCRAPRKKGCWKCGREGHQMKDCTERQANFLGKIWPSNKGRPGNFLQSRPEPTAPPAESFGFGETTPAPKQELKDREPLTSLKSLFGNDPLSQ

SEQ ID NO: 64 - protein, 505 aa, Human immunodeficiency virus 1
MGARASILRGGKLDKWEKIRLRPGGRKHYMLKHIVWASRELERFALNPGLLETAEGCKQIIKQLQPALQTGTEELKSLFNTVATLYCVHEKIEVRDTKEALDKIEEEQNKCQQKTQQAKAADGKVSQNYPIVQNLQGQMVHQAISPRTLNAWVKVIEEKGFNPEVIPMFTALSEGAAPQDLNTMLNTIGGHQAAMQMLKDTINEEAAEWDRLHPVQAGPVAPGQMREPRGSDIAGTTSSLQEQIAWMTGNPPVPVGDIYKRWIILGLNKIVRMYSPVSILDIRQGPKEPFRDYVDRFFKVLRAEQATQDVKNWMTETLLVQNANPDCKTILRALGPGATLEEMMTACQGVGGPSHKARVLAEAMSQANNANIMMQRSNFKGPKRIVKCFNCGKEGHIAKNCRAPRKKGCWKCGQEGHQMKDCNERQANFLGRIWPSHKGRPGNFIQSRPEPTAPLEPTAPPAEPTAPPAESFKFEETTPAPKQEPKDREPLTSLRSLFGSDPLSQ

SEQ ID NO: 65 - protein, 491 aa, Human immunodeficiency virus 1
MGARASVLRGEKLDTWERIKLRPGGKKHYMIKHLVWASRELEKFALNPGLLETAEGCKQIIRQLQPALQTGTEELRSLYNTVATLYCVHKRIDVRDTKEALDKIEEEQNKSQQKAQQAKAADGKVSQNYPIVQNLQGQMVHQSLSPRTLNAWVKVIERKAFSPEVIPMFSALSEGATPQDLNTMLNTVGGHQAAMQMLKDTINEEAAEWDRIHPVHAGPIAPGQMREPRGSDIAGTTSTLQEQITWMTSNPPVPVGEIYKRWIILGLNKIVRMYSPVSILDIRQGPKEPFRDYVDRFFKTLRAEQSTQEVKNWMTDTLLAQNANPDCKIILRGLGPGATLEEMMTACQGVGGPGHKARVLAEAMSQANSNILMQRSNFKGPRRTIKCFNCGKEGHLAKNCRAPRKKGCWKCGKEGHQMKECTERQANFLGKIWPSQKGRPGNFLQSRPEPSAPPAESFRFEETTPALKQEPKDREPLTSLRSLFGSDPLSQ

SEQ ID NO: 66 - protein, 499 aa, Human immunodeficiency virus 1
MGASASILRGEKLDRWEKIRLRPGGKKCYMLKHIIWASKELERFALNPGLLETSEGCKQIMKQLQPALQTGTEELKSLYNTVATLYCVHEKIEVRDTKEALDKIEEEQKKSQQKTQQAEAADKGKVSQNYPIVQNAQGQMVHQALSPRTLNAWVKVVEEKAFSPEIIPMFTALSEGAAPQDLNTMLNTVGGHQAAMQMLKDTINEEAAEWDRVHPVHAGPIAPGQIREPRGSDIAGTTSTLQEQVAWMTSNPPVPVGDIYKRWIVLGLNKIVRMYSPVSILDIKQGPKEPFRDYVDRFFKTLRAEQSSQEVKNWMTDTLLVQNANPDCKTILRALGPAASLEEMMTACQGVGGPSHKARVLAEAMSQANSTNIMMQRGNFKGPKRIVKCFNCGREGHIARNCRAPRKKGCWKCGQEGHQMKDCIERQANFLGKIWPSHKGRPGNFIQSRPEPTAPPEPTAPPAESFRFGETTPAPKQESKDREPLTSLKSLFGNDPLSQ

SEQ ID NO: 67 - protein, 499 aa, Human immunodeficiency virus 1
MGARASVLKGEKLDKWERIRLRPGGKKQYRLKHLVWASRELERFALNPSLLETSEGCRQIIKQLQPALKTGTEELRSLYNTIATLYCVHKGIKVQDTKEALDKVEEEQNKSQQKTQQAKAADEKVSQNYPIVQNLQGQMVHQPLSPRTLNAWVKVIEEKGFNPEVIPMFTALSEGATPQDLNSMLNAVGGHQAAMQMLKDTINEEAAEWDRLHPVQAGPVAPGQIREPRGSDIAGTTSSLQEQIAWMTGNPPVPVGDIYKRWIILGLNKIVRMYSPVSILDIKQGPKESFRDYVDRFFKTLRAEQATQDVKNWMTETLLVQNANPDCKTILRALGPGATLEEMMTACQGVGGPSHKARVLAEAMSQANNANIMMQRSNFKGPKRTVKCFNCGKEGHIAKNCRAPRKKGCWKCGREGHQMKDCIERQANFLGKIWPSNKGRPGNFLQNRTEPTAPPAEPTAPPAESFRFEETTPAPKQELKDREPLTSLKSLFGSDPLLQ

SEQ ID NO: 68 - protein, 492 aa, Human immunodeficiency virus 1
MGARASILRGEKLDKWEKIRLRPGGRKHYMLKHIVWASRELEGFALNPGLLETSEGCKQIIKQLQPALQTGTEELRSLFNTVATLYCVHSGIEVRDTKEAVDKIEEEQNKIQQKTQQAKEADGKVSQNYPIVQNSQGQMVHQAISPRTLNAWVKVIEEKAFSPEVIPMFTALSEGATPSDLNTMLNTIGGHQAAMQMLKDTINDEAAEWDRLHPVHAGPIAPGQMRDPRGSDIAGSTSTLQEQIAWMTNNPPVPVGDIYKRWIIMGLNKIVRMYSPVSILDIKQGPKEPFRDYVDRFFRTLRAEQATQEVKNWMTETLLVQNANPDCRTILKALGPGATLEEMMTACQGVGGPGHKARVLAEAMSQANNINIMMQRNNFKGPKRIIKCFNCGKEGHIARNCKAPRKKGCWKCGKEGHQMKDCNERQANFLGKIWPSHKGRPGNFLQNRPEPTAPPAESFRFEETTPTPKQEPKDREPLTSLKSLFGSDPSSQ

SEQ ID NO: 69 - protein, 498 aa, Human immunodeficiency virus 1
MGARASILRGGKLDKWEKIRLRPGGKKRYMLKHLIWASRELERFALNPGLLETSDGCKQIIQQLQPALKTGTEELKSLFNTVAVLYCVHKGIEVRDTKEAVDKIEEEQNKIQQKMQQQKVTDGKVSQNYPIVQNIQGQMVHQPISPRTLNAWVKVIEEKGFSPEVIPMFTALSEGATPSDLNTMLNTVGGHQAAMQMLKDTINEEAAEWDRTHPVHAGPVAPGQMREPRGSDIAGTTSTLQEQIGWMTNNPPIPVGEIYKRWIILGLNKIVRMYSPVSILDIKQGPKEPFRDYVDRFFKALRAEQATQEVKGWMTDTLLVQNANPDCKTILKALGSGATLEEMMTACQGVGGPGHKARVLAEAMSQANNTNIMMQKSNFKGPRRIVKCFNCGREGHIAKNCRAPRKKGCWKCGQEGHQMKDCTERQANFLGRIWPSHKGRPGNFLQSRPEPTAPLQPTAPPAESFKFEETTPAPKQEQKDREPLTSLRSLFGNDPLSQ

SEQ ID NO: 70 - protein, 499 aa, Human immunodeficiency virus 1
MGARASILRGGKLDTWEKIRLRPGGKKHYMLKHLVWASRELDRFALNPGLLETADGCKQIIKQLHPALQTGTEEIKSLFNTVATLYCVHAGIEVRDTKEALDKIEEEQNKCQQKTQQAKEADKKVSQNYPIVQNLQGQMVHQAISPRTLNAWVKVIEEKAFNPEIIPMFTALSDGATPQDLNTMLNTVGGHQAAMQMLKDTINEEAADWDRLHPVHAGPVAPGQLREPRGSDIAGTTSNLQEQIAWMTSNPPIPVGDIYKRWIILGLNKIVRMYSPVSILDIKQGPKEPFRDYVDRFFKVLRAEQATQDVKNWMTDTLLIQNANPDCKTILRALGPGASLEEMMTACQGVGGPSHKARVLAEAMSQTNSAILMQRSNFKGSKRIVKCFNCGKEGHLARNCRAPRKRGCWKCGKEGHQMKDCTTERQANFLGKIWPSHKGGRPGNFLQNRPEPTAPLEPTAPPAESFGFGETTPAPKQEPKDREPLISLKSLFGSDPLSQ

SEQ ID NO: 71 - protein, 499 aa, Human immunodeficiency virus 1
MGARASILRGGKLDKWEKIRLRPGGKKHYMLKHLVWASRELERFALNPGLLETSEGCKQIIKQLQPALQTGTEELRSLFNTVATLYCVHEKIEVRDTKEALDKIEEEQNKSQQKTQQAKAADGKVSQNYPIVQNLQGQMVHQAISPRTLNAWVKVIEEKAFSPEVIPMFTALSEGATPQDLNTMLNTVGGHQAAMQMLKDTINEEAAEWDRLHPVHAGPIAPGQMREPRGSDIAGTTSTLQEQIAWMTSNPPIPVGEIYKRWIILGLNKIVRMYSPVSILDIRQGPKEPFRDYVDRFFKTLRAEQATQDVKNWMTDTLLVQNANPDCKTILRALGPGATLEEMMTACQGVGGPSHKARVLAEAMSQANNTNIMMQRSNFKGSKRIVKCFNCGKEGHIARNCRAPRKKGCWKCGKEGHQMKDCTERQANFLGKIWPSHKGRPGNFLQSRPEPTAPPAEPTAPPAESFRFEETTPAPKQEPKDREPLTSLKSLFGSDPLSQ

SEQ ID NO: 72 - protein, 497 aa, Human immunodeficiency virus 1
RASVLSGGKLDAWEKIRLRPGGKKKYKLKHIVWASRELERFAVNPGLLETSEGCRQILGQLQPSLQTGSEELRSLYNTVAVLYCVHQRIEVKDTKEALEKIEEEQNKSKKKAQQAAADTGNSSQVSQNYPIVQNLQGQMVHQAISPRTLNAWVKVIEEKAFSPEVIPMFTALSEGATPSDLNTMLNTIGGHQAAMQILKDTINEEAAEWDRLHPVHAGPIAPGQMREPRGSDIAGTTSTLQEQIGWMTNNPPIPVGEIYKRWIILGLDKIVRMYSPTSILDIRQGPKESFRDYVDRFYKTLRAEQASQEVKNWMTETLLVQNANPDCKTILKALGPAATLEEMMTACQGVGGPSHKARILAEAMSQVTNSATIMMQRGNFRNQRKTVKCFNCGKEGHIAKNCRAPRKKGCWKCGKEGHQMKDCNERQANFLGKIWPSHKGRPGNFLQSRPEPTAPPEESFRFGEETTTPSQKQEPIDKELYPLASLKSLFGNDPLSQ

SEQ ID NO: 73 - protein, 494 aa, Human immunodeficiency virus 1
MGARASILRGGKLDKWEKIRLRPGGKKHYMLKHLVWASRELERFALNPGLLETAEGCKQIIKQLQPALKTGTEELKSLYNTVATLYCVHEKIEVRDTKEALDKLEEEQNKSQQKTQQAAAGTGSSSKVSQNYPIVQNAQGQMVHQALSPRTLNAWVKVVEEKAFSPEVIPMFSALAEGATPQDLNTMLNTVGGHQAAMQMLKDTINEEAADWDRLHPVHAGPVAPGQMREPRGSDIAGSTSTLQEQIAWMTSNPPIPVGDIYKRWIILGLNKIVRMYSPVSILDIKQGPKEPFRDYVDRFFKTLRAEQATQDVKNWMTDTLLVQNANPDCKTILRALGPGASLEEMMTACQGVGGPGHKARVLAEAMSQANNANIMMQRGNFKGQKRIKCFNCGKEGHLARNCRAPRKKGCWKCGREGHQMKDCTERQANFLGRIWPSSKGRPGNFPQSRPEPSAPPAESFGFGETTPAPKQELKDREPLTSLKSLFGSDPLSQ

SEQ ID NO: 74 - protein, 498 aa, Human immunodeficiency virus 1
MGARASVLSGGELDRWEKIRLRPGGKKKYRLKHLVWASRELEKFALNPGLLETSEGCKQIMKQLQPALQTGTEELRSLFNTVATLYCVHQRIDVKDTKEALDKIEEEQNKIQQKTQQAKAADGKVSQNYPIVQNIQGQMVHQPISPRTLNAWVKVVEEKGFNPEVIPMFSALSEGATPQDLNMMLNIVGGHQAAMQMLKETINEEAAEWDRVHPVHAGPIPPGQMREPRGSDIAGTTSNLQEQIGWMTSNPPVPVGDIYKRWIVLGLNKIVRMYSPVSILDIRQGPKEPFRDYVDRFFKVLRAEQATQEVKNWMTDTLLIQNANPDCKSILRALGPGATLEEMMTACQGVGGPSHKARVLAEAMSQTNSAILMQRSNFKGSKRIVKCFNCGKEGHIARNCRAPRKRGCWKCGQEGHQMKDCTERQVNFLGKIWPSNKGRPGNFLQNRPEPTAPPAEPTAPPAESFRFEETTPAPKQEPKDREPLTSLRSLFGNDPSSQ

SEQ ID NO: 75 - protein, 494 aa, Human immunodeficiency virus 1
MGARASVLSGGELDRWEKIRLRPGGKKKYKLKHIVWASRELERFAVNPGLLETSEGCRQILGQLQPSLQTGSEELRSLYNTVAVLYCVHQRIDVKDTKEALEKIEEEQNKSQQKTQQAKAADGKVSQNYPIVQNAQGQMVHQAISPRTLNAWVKVIEEKGFSPEVIPMFSALAEGATPQDLNTMLNTIGGHQAAMQMLKDTINDEAAEWDRLHPVQAGPVAPGQIREPRGSDIAGTTSNLQEQIGWMTSNPPIPVGDIYKRWIIMGLNKIVRMYSPTSILDIRQGPKESFRDYVDRFFRTLRAEQASQEVKNWMTETLLVQNSNPDCKTILKALGPAATLEEMMTACQGVGGPGHKARVLAEAMSQVQQPNIMMQRGNFKGQKRIKCFNCGREGHLARNCRAPRKKGCWKCGREGHQMKDCTESKANFLGKIWPSNKGRPGNFLQSRPEPSAPPAESFGFGEEITPSQKQEQKDKELYPLASLKSLFGNDPLSQ

SEQ ID NO: 76 - protein, 497 aa, Human immunodeficiency virus 1
MGARASVLSGGKLDAWEKIRLRPGGKKKYRLKHLVWASRELDRFALNPSLLETAEGCKQIMKQLQPALKTGTEELKSLYNTVATLYCVHEKIDVRDTKEALDKIEEEQNKIQQKTQQAKEADGKVSQNYPIVQNIQGQMVHQPISPRTLNAWVKVVEEKAFSPEVIPMFTALSDGATPQDLNSMLNAVGGHQAAMQILKDTINEEAADWDRLHPVHAGPVAPGQMREPRGSDIAGTTSTLQEQIGWMTNNPPIPVGEIYKRWIILGLNKIVRMYSPVSILDIKQGPKESFRDYVDRFFKVLRAEQATQDVKNWMTDTLLIQNANPDCKSILRALGPGATLEEMMTACQGVGGPSHKARILAEAMSQVTNSATIMMQRGNFRNQRKTVKCFNCGKEGHLARNCKAPRKRGCWKCGKEGHQMKECTERQANFLGKIWPSSKGRPGNFPQSRPEPTAPPEESFRFGEETTTPSQKQEPIDKELYPLASLRSLFGNDPSSQ

SEQ ID NO: 77 - protein, 500 aa, Human immunodeficiency virus 1
MGARASILRGGKLDKWEKIRLRPGGKKRYMLKHLIWASRELERFALNPGLLETAEGCQQIIEQLQSTLKTGSEELKSLFNTVATLYCVHQRIEVKDTKEALDKVEEEQNKSKKKAQQAAADTGNSSQVSQNYPIVQNLQGQMVHQALSPRTLNAWVKVIEEKAFSPEIIPMFTALSEGATPSDLNTMLNTVGGHQAAMQMLKDTINEEAAEWDRVHPVHAGPIPPGQMREPRGSDIAGTTSSLQEQIAWMTSNPPVPVGEIYKRWIVLGLNKIVRMYSPVSILDIRQGPKEPFRDYVDRFFKTLRAEQASQDVKNWMTETLLVQNANPDCKTILRALGPGASLEEMMTACQGVGGPSHKARVLAEAMSQTNSAILMQRSNFKGSKRIVKCFNCGKEGHIARNCRAPRKRGCWKCGQEGHQMKDCNERQANFLGKIWPSHKGRPGNFLQNRPEPTAPPEPTAPPAESFRFEETTPAPKQELKDREPLTSLKSLFGSDPLSQ

SEQ ID NO: 78 - protein, 502 aa, Human immunodeficiency virus 1
MGARASVLRGEKLDKWERIRLRPGGKKHYMLKHLVWASRELEKFALNPGLLETSEGCKQIIKQLQPALQTGTEELRSLFNTVATLYCVHAGIEVRDTKEALDKIEEIQNKSKQKTQQAAAGTGSSSKVSQNYPIVQNLQGQMVHQPLSPRTLNAWVKVVEEKGFNPEVIPMFSALSEGATPQDLNMMLNIVGGHQAAMQMLKETINEEAAEWDRLHPVHAGPIAPGQMREPRGSDIAGSTSTLQEQIAWMTGNPPVPVGDIYKRWIILGLNKIVKMYSPTSILDIKQGPKEPFRDYVDRFYKTLRAEQATQEVKNWMTDTLLVQNANPDCKSILKALGTGATLEEMMSACQGVGGPAHKARVLAEAMSQANNTNIMMQRSNFKGPKRIIKCFNCGKEGHIAKNCRAPRKKGCWKCGKEGHQMKDCTERQANFLGRIWPSSKGRPGNFLQSRPEPTAPPAEPTAPPAESFKFEETTPAPKQEPKDREPLTSLRSLFGSDPLLQ

SEQ ID NO: 79 - protein, 495 aa, Human immunodeficiency virus 1
MGARASILSGGKLDAWEKIRLRPGGRKHYMLKHIVWASRELERFALNPGLLETAEGCQQIIEQLQSTLKTGSEELKSLFNTVATLWCVHQRIEVKDTKEALDKLEEEQNKSQQKTQQAKAADGKVSQNYPIVQNLQGQMVHQSISPRTLNAWVKAIEEKAFSPEVIPMFSALAEGATPQDLNTMLNTIGGHQAAMQILKDTINEEAAEWDRIHPVHAGPVAPGQMRDPRGSDIAGTTSNLQEQIAWMTSNPPVPVGEIYKRWIILGLDKIVRMYSPVSILDIRQGPKEPFRDYVDRFFKTLRAEQATQEVKGWMTDTLLVQNANPDCKTILKALGPGATLEEMMSACQGVGGPGHKARVLAEAMSQANNTNIMMQKSNFKGPKRIIKCFNCGKEGHLARNCRAPRKKGCWKCGQEGHQMKDCTERQANFLGRIWPSHKGRPGNFPQSRLEPTAPPAESFGFGEEIAPSPKQEPKEKELYPLTSLKSLFGNDPLSQ

SEQ ID NO: 80 - protein, 496 aa, Human immunodeficiency virus 1
MGARASILRGGKLDKWEKIRLRPGGKKKYKLKHIVWASRELEKFALNPGLLETSEGCRQILGQLQPSLQTGSEELKSLYNTVATLYCVHQRIDVKDTKEALEKIEEEQNKSQQKTQQAAADKGVSQNYPIVQNLQGQMVHQAISPRTLNAWVKVIEEKAFSPEIIPMFTALSEGATPQDLTTMLNTVGGHQAAMQMLKETINDEAAEWDRLHPVHAGPVAPGQLREPRGSDIAGSTSTLQEQIAWMTGNPPVPVGDIYKRWIVLGLNKIVRMYSPTSILDIRQGPKEPFRDYVDRFYKTLRAEQASQDVKNWMTETLLVQNANPDCRTILKALGPAATLEEMMTACQGVGGPAHKARVLAEAMSQVTNPATIMMQRGNFRNQRKTVKCFNCGKEGHLAKNCRAPRKRGCWKCGKEGHQMKDCNERQANFLGKIWPSNKGRPGNFLQNRTEPTAPPAESFRFGEEKTTPSQKQEPIDKELYPLASLRSLFGNDPSLQ

SEQ ID NO: 81 - protein, 514 aa, Human immunodeficiency virus 1
MGARASVLRGEKLDKWERIRLRPGGKKRYMLKHLIWASRELERFALNPSLLETSEGCKQIIQQLQPALKTGTEELRSLYNTVATLYCVHEKIEVRDTKEAVDKIEEEQNKSKKKAQQAAADTGNSSQVSQNYPIVQNIQGQMVHQALSPRTLNAWVKVVEEKGFNPEVIPMFSALSEGATPQDLNMMLNIVGGHQAAMQMLKDTINEEAAEWDRLHPVQAGPVAPGQMREPRGSDIAGTTSTLQEQITWMTSNPPIPVGEIYKRWIIMGLNKIVRMYSPVSILDIKQGPKESFRDYVDRFFRTLRAEQASQEVKNWMTETLLIQNANPDCKTILRALGPAASLEEMMTACQGVGGPGHKARVLAEAMSQTNSAILMQRSNFKGSKRIVKCFNCGKEGHIARNCRAPRKKGCWRCGKEGHQMKDCTESKANFLGKIWPSHKGRPGNFLQNRPEPTAPPEPTAPPAEPTAPPAEPTAPPAESFKFEETTPAPKQELKDREPLISLKSLFGSDPLLQ

SEQ ID NO: 82 - protein, 491 aa, Human immunodeficiency virus 1
MGARASILRGEKLDTWEKIRLRPGGKKQYRLKHIVWASRELDRFALNPSLLETAEGCKQIIKQLHPALQTGTEELRSLFNTVATLYCVHAGIEVRDTKEALDKIEEEQNKIQQKTQQAKAADEKVSQNYPIVQNMQGQMVHQPLSPRTLNAWVKVVEEKAFSPEVIPMFAALSEGATPSDLNTMLNTVGGHQAAMQMLKDTINDEAAEWDRLHPAQAGPIPPGQIREPRGSDIAGTTSTPQEQIGWMTNNPPIPVGEIYKRWIVLGLNKIVRMYSPISILDIRQGPKEPFRDYVDRFFKALRAEQATQEVKGWMTETLLVQNSNPDCKTILRALGPGASLEEMMTACQGVGGPSHKARILAEAMSQANSNIMMQRSNFKGPKRIVKCFNCGKEGHIAKNCRAPRKKGCWKCGREGHQMKDCIERQANFLGKIWPSQKGRPGNFLQSRPEPSAPPAESFRFGETTPAPKQEPKDREPLTSLRSLFGSDPLSQ

SEQ ID NO: 83 - protein, 498 aa, Human immunodeficiency virus 1
MGARASVLSGGELDRWEKIRLRPGGKKKYRLKHLVWASRELERFAINPGLLETSDGCKQIIKQLQPALQTGSEELRSLYNTIATLYCVHQKIEVKDTKEALDKIEEIQNKSKQKTQQAAAGTGSSSKVSQNYPIVQNAQGQMVHQSLSPRTLNAWVKVIEEKGFNPEVIPMFTALSEGATPHDLNTMLNTVGGHQAAMQMLKETINEEAAEWDRVHPVHAGPIPPGQMREPRGSDIAGSTSTLQEQIGWMTSNPPIPVGDIYKRWIILGLNKIVRMYSPSSILDIRQGPKESFRDYVDRFFKCLRAEQATQEVKNWMTDTLLIQNANPDCKSILRALGPGATLEEMMTACQGVGGPGHKARILAEAMSQVQQPNIMMQRGNFKGQKRIKCFNCGREGHIARNCKAPRKKGCWKCGKEGHQMKDCTERQVNFLGKIWPSYKGRPGNFLQSRPEPTAPPEESFRFGEETTTPSQKQETIDKELYPLASLKSLFGNDPSSQ

SEQ ID NO: 84 - protein, 493 aa, Human immunodeficiency virus 1
MGARASVLSGGKLDAWERIRLRPGGKKHYMLKHLVWASRELERFAVNPGLLETSEGCKQIMKQLQPALQTGTEELKSLYNTVAVLYCVHQRIEIKDTKEALDKIEEEQNKCQQKTQQAKEADGKVSQNYPIVQNLQGQMVHQPISPRTLNAWVKVIEEKGFSPEVIPMFTALSDGATPQDLNSMLNAVGGHQAAMQMLKDTINEEAADWDRLHPVHAGPIAPGQMREPRGSDIAGTTSSLQEQIAWMTNNPPVPVGEIYRRWIILGLNKIVKMYSPTSILDIKQGPKEPFRDYVDRFFKVLRAEQATQDVKNWMTDTLLVQNANPDCKSILKALGTGATLEEMMTACQGVGGPSHKARVLAEAMSQVTNSATIMMQKGNFRNQRKIVKCFNCGREGHLARNCKAPRKRGCWKCGKEGHQMKECTERQANFLGKIWPSSKGRPGNFPQSRPEPTAPPAESFRFEETTPAPKQESKDREPLTSLKSLFGSDPSSQ

SEQ ID NO: 85 - protein, 871 aa, Human immunodeficiency virus 1
MRVTGIRKNYQHLWRWGTMLLWRWGTMLLGMLMICSATEKLWVTVYYGVPVWKEATTTLFCASDAKAYDTEVHNVWATHACVPTDPNPQEVVLENVTENFNMWKNNMVEQMHEDIISLWDQSLKPCVKLTPLCVTLNCTDDVRNVTNNATNTNSSWGEPMEKGEIKNCSFNITTSIRDKVQKEYALFYKLDVVPIDNDSNNTNYRLISCNTSVITQACPKVSFEPIPIHYCAPAGFAILKCNDKKFNGTGPCTNVSTVQCTHGIRPVVSTQLLLNGSLAEEEVVIRSENFTNNAKTIMVQLNVSVEINCTRPNNNTRKSIHIGPGRAFYTTGDIIGDIRQAHCNISRAQWNNTLKHIVEKLGKQFGNNKTIVFNHSSGGDPEIVMHSFNCGGEFFYCNSTKLFNSTWTRNNGTWTRNDTERSNSTEEHITLPCRIKQIINMWQEVGKAMYAPPIRGQIRCSSNITGLLLTRDGGNDTSGTEIFRPGGGDMRDNWRSELYKYKVVKIEPLGVAPTKAKRRVVQREKRAVGIGAVFLGFLGAAGSTMGAASMTLTVQARQLLSGIVQQQNNLLRAIEAQQHLLQLTVWGIKQLQARVLAVERYLRDQQLLGIWGCSGKLICTTAVPWNASWSNKSLNEIWNNMTWMEWEKEIDNYTNLIYNLLEESQNQQEKNEQELLELDKWASLWNWFDISNWLWYIKIFIMIVGGLVGLRIVFAVLSIVNRVRQGYSPLSFQTRLPAPRGPDRPEGIEEEGGERDRDRSVRLVDGFLALIWDDLRSLCLFSYHRLRDLLLIVTRIVELLGRRGWEALKYWWNLLQYWSQELKNSAVSLLNATAIAVAEGTDRVIEALQRACRAILHIPRRIRQGLERALL

SEQ ID NO: 86 - protein, 861 aa, Human immunodeficiency virus 1
MRVKETRKNYQHLWKWGTMLLGMLMICSATEKLWVTVYYGVPVWRDANATLFCASDAKAYDTEAHNVWATHACVPTDPNPQEVELKNVTENFNMWKNDMVEQMHEDIINLWDQSLKPCVELTPLCVTLNCTDYVKNITNNATSTNSSWGKPMEKGEIKFCSFNITTSIRNKVQKQYALFYKLDIVPIDNDNTSYRLISCNTSTITQACPKVTFEPIPIHYCAPAGFAILKCNNKTFNGTGPCTNVSTVQCTHGIRPVISTQLLLNGSLAEEEVVIRSENFTNNAKTIMVQLNVSVEINCTRPNNNTRRSIPIGPGRVFYTTEDIIGDIRQAHCNISRAQWNNTLKHIVEKLGKQFGNNKTIVFNHSSGGDPEIVMHSFNCRGEFFYCKSTKLFNSTWTRNNGTWTRNDTERSNSTEEHITLPCRIKQIINMWQEVGKAMYAPPIKGQISCSSNITGLLLTRDGGNDTSGTEIFRPGGGDMRDNWRSELYKYKVVRIEPLGVAPTEAKRRVVQREKRAVGIGAVFLGFLGAAGSTMGAASMTLTVQARLLLSGIVQQQSNLLRAIEAQQHMLQLTVWGIKQLQARLLAVERYLGDQQLLGLWGCSGKLICTTTVPWNTSWSNKSLNEIWDNMTWMQWEREIDNYTGLIYNLLEKSQNQQEKNEQELLELDKWASLWNWFDITNWLWYIKIFIMIVGGLVGLRIVFTVLSIVNRVRKGYSPLSFQTRLPTPRGPDRPGGIEEEGGEQDRDRSGPLVNGFLALIWVDLRSLFLFSYHRLRDLLLIVARIVELLGRRGWEILKYWWNLLLYWSQELKNSAVSLLNATAIAVAEGTDRVIEVVQRAFRAILHIPRRIRQGFERALL

SEQ ID NO: 87 - protein, 871 aa, Human immunodeficiency virus 1
MRVTGIRKNYQHLWRWGTMLLWRWGTMLLGILMICSAAGKLWVTVYYGVPVWKEANTTLFCASDAKAYDTEVHNVWATHACVPIDPNPQEVVLGNVTENFNMWKNNMVEQMHEDIISLWDESLKPCVKLTPICVTLNCTDDVRNVTNNATNTNSSWGEPMEKGEIKNCSFNITTSIRDKVQKQYALFYKLDVVPIDNDSNNTNYRLISCNTSVITQACPKISFEPIPIHFCAPAGFAILKCNDKKFNGTGPCKNVSTVQCTHGIKPVVSTQLLLNGSLAEEEIVIRSENFTDNAKTIIVQLNESVVINCTRPNNNTRKSIHIGPGRAFYATGEIIGDIRQAHCNLSRAKWNDTLKQIVIKLREQFGNKTIVFNQSSGGDPEIVMHSFNCGGEFFYCNTTQLFNSTWTWNNSTWNNTKRSNDTEEIITLPCRIKQIVNMWQKVGKAMYAPPIRGQIRCSSNITGILLTRDGGNNNETNRTETFRPGGGNMKDNWRSELYKYKVVKIEPLGIAPTKARRRVVQREKRAVGTIGAMFLGFLGAAGSTMGAASLTLTVQARQLLPGIVQQQNNLLKAIEAQQHLLRLTVWGIKQLQARVLAVERYLRDQQLLGIWGCSGKIICTTAVPWNASWSNKSLDKIWDNMTWMEWEKEIDNYTNLIYNLLEESQNQQEKNELELLELDKWANLWNWFDISNWLWYIKIFIMIIGGLVGLRIVFAVLSIVNRVRQGYSPLSFQTRLPAPRGPDRPEGIEEEGGERDRDRSVRLVDGFLALIWDDLRSLCLFLYHRLRDLLLIAARIVELLGRRGWEALKYWWNLLQYWSQELKNSAISLLNATAVAVAEGTDRVIEALQRACRAILHIPRRIRQGLERLLL

SEQ ID NO: 88 - protein, 874 aa, Human immunodeficiency virus 1
MRVKGIRKNCQHLWRWGIMLLGMLMICSAAEQLWVTVYYGVPVWKEATTTLFCASDAKAYDKEVHNVWATHASVPTDPNPQEVVLENVTENFNMWKNNMVDQMHEDIISLWDQSLKPCVKLTPLCVTLNCTDLRNATNGNDTNTTSSSREMMGGGEMKNCSFNVTTSIRDKVQKEYALFYKLDVIPIDSRNNSNNSTEYNSYRLINCNTSVITQACPKVSFEPIPIHYCTPAGFAILKCKDKKFNGTGPCTKVSTVQCTHGIRPVVSTQLLLNGSLAEEEVIIRSENFTNNAKTIIVQLKEAVEINCTRPSNNTRKSIPIGPGRAFYTTGDIIGDIRKAHCNISRANWNNTLRQIVEKLGEQFGNNKTIIFKQSSGGDPEIVTHSFNCGGEFFYCNSTQLFNSTWNFNGTWNKNFNNTWNNTEGTNDTITLPCRIKQIINRWQEVGKAMYAPPISGQIRCSSNITGLILTRDGGNNGNETNGTEIFRPGGGNMRDNWRSELYRYKVVKIEPLGVAPTKAKRRVVQREKRAVGIGALFLGFLGAAGSTMGAASITLTVQARQLLSGIVQQQNNLLRAIEAQQHLLQLTVWGIKQLQARILAVERYLKDQQLLGIWGCSGKLICTTAVPWNTSWSNRSLNEIWNNMTWMEWEREIDNYTSLIYTLIEESQNQQEKNEQELLALDKWASLWNWFSITNWLWYIRIFIMIVGGLIGLRIVFAVLSVVNRVRQGYSPLSFQTHLPAQRGPDRPEGTEEEGGERDRDRSGRLVDGFLAIIWVDLRSLCLFSYHRLRDLLLIVTRIVELLGRRGWEVLKYWWNLLQYWIQELKNSAVSLFNAIAIAVAEGTDRIIEVVQRAYRAILHIPTRIRQGLERALL

SEQ ID NO: 89 - protein, 868 aa, Human immunodeficiency virus 1
MRVTGIRKNYQHLWRWGTMLLWRWGTMLLGILMICSAAGKLWVTVYYGVPVWKDATTTLFCASDAKAYDTEVHNVWATHASVPTDPNPQEVVLENVTEDFNMWKNNMVDQMHEDIISLWDQSLKPCVELTPLCVTLNCTDDVRNVTNNATNTNSSWGEPMEKGEIKFCSFNITTSIRNKVQKQYALFYKLDVVPIDNDSNNTNYRLISCNTSVITQACPKVTFEPIPIHYCAPAGFAILKCNNKTFNGTGPCTKVSTVQCTHGIRPVVSTHLLLNGSLAEEEVIIRSENFTDNTKTIIVQLKEAVEINCTRPNNNTRKGIHIGPGRAFYTTGEIIGDIRQAHCNLSRAKWNDTLKQIVIKLREQFGNKTIIFNQSSGGDPEIVMHTFNCGGEFFYCNTTQLFNSTWQNETSGSINITDIGENITLPCRIKQIVNMWQKVGKAMYAPPIKGQISCSSNITGLLLTRDGGNNGNETNGTEIFRPGGGNMKDNWRSELYRYKVVKIEPLGVAPTRAKRRVVQREKRAVTLGAMFLGFLGAAGSTMGAASMTLTVQARLLLSGIVQQQSNLLRAIEAQQHLLRLTVWGIKQLQARILAVERYLQDQQLLGIWGCSGKLICTTAVPWNASWSNKSQDEIWNNMTWMQWEKEIDNYTGLIYTLLEESQIQQEKNEQELLELDKWASLWNWFDITNWLWYIKIFIMIVGGLIGLRIVFTVLSIVNRVRKGYSPLSFQTHLPAPRGPDRPGGIEEEGGEQDRDRSGPLVNGFLALIWVDLRSLFLFSYHRLRDLLLIVARIVELLGRRGWEVLKYWWNLLQYWSQELKNSAISLLNATAVAVAEGTDRVIEALQRACRAILHIPRRIRQGLERLLL

SEQ ID NO: 90 - protein, 875 aa, Human immunodeficiency virus 1
MRVKGIRKNCQHLWRWGILLLGMLMICSAAEQLWVTVYYGVPVWRDANATLFCASDAKAYDTEAHNVWATHACVPTDPNPQEVELKNVTENFNMWKNNMVEQMQEDIISLWDQSLKPCVKLTPICVTLNCTDYVKNITNNATSTNSSWGKPMEKGEIKNCSFNVTTSIRDKVQKEYALFYRLDVVPIDNDSNNNDSTNTNYTNYRLISCNTSTITQACPKVSFQPIPIHYCAPAGFALLKCNDKKFNGTGPCKNVSTVQCTHGIKPVVSTQLLLNGSLAEEEIVIRSENFTNNAKTIIVQLNESVVINCTRPNNNTRKSIHIGPGRAFYATGDIIGDIRKAHCNISRANWNNTLRQIVEKLGEQFGNKTIVFNQSSGGDVEIVMHSFNCGGEFFYCNSTQLFNSTWNFNGTWNKNFNNTWNNTEGTNDTITLPCRIKQIINMWQGVGKAMYAPPISGQIRCSSNITGLILTRDGGNNNETNRTETFRPGGGDMRDNWRSELYKYKVVKIEPLGIAPTKARRRVVQREKRAVGTIGAMFLGFLGTAGSTMGAASLTLTVQARLLLSGIVQQQNNLLKAIEAQQHLLQLTVWGIKQLQARLLAVERYLGDQQLLGLWGCSGKLICTTTVPWNASWSNKSLDKIWDNMTWMEWEREIDNYTGLIYNLLEKSQNQQEKNELELLELDKWANLWNWFDITKWLWYIKIFIMIIGGLIGLRIVFAVLSVVNRVRQGYSPLSLQTRLPTQRGPDRPEGIAEEGGERDRDRSGPLVDGFLAIIWVDLRSLCLFSYHHLRDLLLIVTRIVELLGRRGWEALKYWWNLLLYWSQELKNSAVNLLNTTAIAVAEGTDRIIEVLQRIYRAFLHIPRRIRQGFERALL

SEQ ID NO: 91 - protein, 865 aa, Human immunodeficiency virus 1
MRVKEIRKNYQHLWKWGTMLLGMLMICSAAGNLWVTVYYGVPVWKEANTTLFCASDAKAYETEVHNVWATHACVPIDPNPQEVVLGNVTENFNMGKNNMVEQMHEDIISLWDESLKPCVKLTPLCVTLNCTDELKNATFRSNTTTNSSWEKMEKGEIKNCSFNITTNMRDKMQKEYALFYKLDVIPIDSRNNSNNSTEYNSYRLINCNTSVITQACPKISFEPIPIHYCTPAGFAILKCKDKKFNGKGPCTNVSTVQCTHGIRPVVSTQLLLNGSLAEKEVVIRSDNFTNNAKTIMVQLNVSVEINCTRPNNNTRRSIPIGPGRVFYTTEDIIGDIRQAHCNISRAQWNNTLKHIVEKLGKQFGNNKTIVFNHSSGGDPEIVMHSFNCRGEFFYCKSTKLFNSTWTRNNGTWTRNDTERSNSTEEHITLPCRIKQIINMWQEVGKAMYAPPIRGQIRCSSNITGILLTRDGGNDTSGTEIFRPGGGDMKDNWRSELYKYKVVRIEPLGVAPTEAKRRVVQREKRAVGIGAVFLGFLGAAGSTMGAAAVTLTVQARLLLSGIVQQQNNLLRAIEAQQRLLQLTVWGIKQLQARVLAVERYLRDQQLLGIWGCSGKIICTTAVPWNTSWSNRSLNEIWNNMTWMEWEKEIDNYTNLIYNLLEESQNQQEKNEQELLALDKWANLWNWFDISNWLWYIKIFIIIVGGLVGLRIVFAVLSIVNRVRQGYSPLSFQTRLPAPRGPDRPEGIEEEGGERDRDRSVRLVDGFLALIWDDLRSLCLFSYHRLRDLLLIVELLGRRGWEILKYWWNLLQYWGQELKNSAVSLLNATAIAVAEGTDRVIEVVQRAYRAILHIPTRIRQGLERALL

SEQ ID NO: 92 - protein, 861 aa, Human immunodeficiency virus 1
MRVKETRKNYQHLWRWGIMLLGMLMICSATEKLWVTVYYGVPVWKEATTTLFCASDAKAYDKEVHNVWATHACVPTDPSPQEVVLENVTENFNMWKNDMVEQMHEDIINLWDQSLKPCVRLTPLCVTLNCTNVNVTNLKNETNTKSSSGGEKMEEGEMKNCSFNITTSIRDKVQKQYALFYKLDVVPIDNDNTSYRLISCNTSVIKQACPKVSFEPIPIHFCAPAGFAILKCNDKKFNGTGPCTNVSTVQCTHGIRPVISTQLLLNGSLAEEEVVIRSENFTDNAKTIIVQLNETVEINCTRPSNNTRKSIPIGPGRAFYTTGDIIGDIRQAYCNISRAKWNNTLKQIVTKLREQFGNNKTIIFKQSSGGDPEIVTHSFNCGGEFFYCNSTKLFNSTWTWNNSTWNNTKRSNDTEEIITLPCRIKQIINRWQEVGKAMYAPPIEGQIRCLSNITGLLLTRDGGTNNTNTNETFRPGGGNMRDNWRSELYKYKVVQIEPLGVAPTKAKRRVVQREKRAVGIGALFLGFLGAAGSTMGAASITLTVQARQLLSGIVQQQRNLLRAIEAQQHMLQLTVWGIKQLRARVLAVERYLKDQQLLGIWGCSGRLICTTNVPWNTSWSNKSLNEIWDNMTWMQWEREIDNYTSLIYTLIEESQNQQEKNEQDLLALDKWASLWNWFSITNWLWYIRIFIMIVGGLVGLRIVFTVISIVTRVRQGYSPLSFQTRLPTPRGPDRPEGTEEEGGERDRDRSGRLVDGFLALFWDDLRSLCLFLYHRLRDLLLIAARIVELLGRRGWELLKYWWNLLQYWIQELKNSAVSLFNAIAIAVAEGTDWVIEISQRAFRAVLHIPVRIRQGLERALQ

SEQ ID NO: 93 - protein, 862 aa, Human immunodeficiency virus 1
MRVTGIRKNYQHLWRWGTMLLWRWGTMLLGILMICSAAGKLWVTVYYGVPVWKDATTTLFCASDAKAYDTEAHNVWATHACVPIDPNPQEVVLENVTENFNAWKNNMVEQMHEDMISLWDQSLQPCVRLTPLCVTLNCTDDVRNATSTNSSWGKPMEKGEIKNCSFNITTSIRDKVQKQYALFYKLDVVPIDNDSNNTNYRLISCNTSIITQACPKITFEPIPIHYCTPAGFALLKCNDKKFNGTGPCTKVSTVQCTHGIRPVVSTHLLLNGSLAEEEVIIRSENFTNNAKTIMVQLNVSVEINCTRPSNNTRKSIHIGPGRAFYTTGDIIGDIRKAHCNISRANWNNTLRQIVEKLGEQFGNNKTIVFNHSSGGDLEIVTHSFICGGEFFYCNSTKLFNSTWTWNNSTWNNTKRSNDTEEIITLPCRIKQIINMWQEVGKAMYAPPIRGKIRCSSNITGLLLTRDGGTNNTNTNETFRPGGGDMRDNWRNELYKYKVVRIEPLGIAPTEAKRRVVQREKRAVGIGAMFLGFLGTAGSTMGAASVALTVQARQLLPGIVQQQNNLLRAIDAQQHLLQLTVWGIKQLQARILAVERYLKDQQLLGFWGCSGKLICTTNVPWNTSWSNKSYSQIWENMTWMEWEREINNYTGLIYNLLEKSQNQQEKNEQELLELDKWASLWSWFDISNWLWYIKIFIIIVGGLVGLRIVFAVLSIINRVRQGYSPLSFQTHLPAPRGPDRPEGIAEEGGERDRDRSGRLVNGFLALIWVDLRSLCLFSYHHLRDLLLIVELLGRRGWEVLKYWWNLLLYWSQELKNSAISLLNATAVAVAEGTDRVIEALQRACRAILHIPRRIRQGLERLLL

SEQ ID NO: 94 - protein, 853 aa, Human immunodeficiency virus 1
MRVKETRKNYQHLWKWGTMLLGILMICSATENLWVTVYYGVPVWKEATTTLFCASDAKAYDKEVHNVWATHACVPTDPNPQEVELKNVTENFNMWKNNMVEQMQEDIISLWDQSLKPCVRLTPLCVTLNCTDLRNATNGNDTNTTSSSREMMGGGEMKNCSFNITTNIRDKVQKEYALFYKLDIVPIDNDNTNYRLISCNTSVVTQACPKVSFEPIPIHFCAPAGFAILKCNDKKFNGKGPCTNVSTVQCTHGIRPVISTQLLLNGSLAEEEVVIRSENFTNNVKTIIVQLNETVEINCTRPNNNTRRSIPIGPGRVFYTTEDIIGDIRQAHCNLSRTQWNNTLKQIVTKLREQFGNKTIIFNQSSGGDPEIVMHTFNCGGEFFYCNTTKLFNSTWNDTTINRTEGSNNTRNITLPCRIKQIINLWQEVGKAMYAPPIQGQISCSSNITGLLLTRDGGNNNETNRTETFRPGGGNMRDNWRSELYKYKVVKIEPLGVAPTKAKRRVVQREKRAVGIGALFLGFLGAAGSTMGAASVTLTVQARQLLSGIVQQRNNLLRAIEAQQRMLQLTVWGIKQLRARVLAVERYLKDQQLMGIWGCSGKLICTTTVPWNASWSNKSLNEIWDNMTWMEWEREIDNYTSLIYTLIEESQNQQEKNELELLELDKWASLWNWFSITNWLWYIRLFIMIVGGLVGLRIVFTVISIVTRVRQGYSPLSFQTRLPTPRGPDRPGGIEEEGGEQDRDRSIRLVDGFLALIWDDLRSLCLFSYHRLRDLLWIVELLGRRGWEALKYLWNLLQYWSQELKKSAVSLFNATAIAVAEGTDWVIEVIQRAFRAFIHIPTRVRQGLERALQ

SEQ ID NO: 95 - protein, 849 aa, Human immunodeficiency virus 1
MRVKGIRKNCQHLWRWGILLLGMLMICSATEKLWVTVYYGVPVWKETTTTLFCASDAKAYVAEKHNVWATHACVPTDPNPREVVMGNVTEEFNIWNNSMVEQMHEDIISLWEQSLKPCVKLTPLCVSLKCTDLKNDTNTNSSSGRMIMEKGEIKNCSFNITTGIRGKVQEYSLFYKLDVVQMDEDNTSYRLINCNTSVITQACPKVSFQPIPIHYCAPAGFAILKCKDKKFNGTGSCKNVSTVQCTHGIRPVISTQLLLNGSLAEGEVVIRSENFTDNAKTIIVQLKDPVKINCTRPNNNTRKSIPIGPGRAFYATGDIIGDIRQAHCNISTTKWNKTLGQVVKKLREQFKNKTIVFKQSSGGDPEVVMHSFNCGGEFFYCNTSQLFNSTWNSTSLFNSTNGTITLQCRIKQIINRWQEVGKAMYAPPIEGQIRCLSNITGLLLVRDGGINVTNNTGTEVFRPGGGDMRDNWRSELYKYKVIKIEPLGVAPTRAKRRVVQREKRAVGLGAMFLGFLGAAGSTMGAASITLTVQARQLLSGIVQQQRNLLRAIEAQQHMLQLTVWGIKQLQARVLAVERYLQDQQLLGIWGCSGKLICTTTVPWNTSWSNKSLNQIWDNMTWMQWEKEIDNYTGLIYTLLEESQNQQEKNEHELLELDKWASLWNWFNITNWLWYIKIFIMIIGGLIGLRIVFAVLSIVNRVRQGYSPISFQTRLPAPRGPDRPDGIEEEGGDRDRDRSGRLVDGFLTLIWVDLRSLCLFSYRRLRDLLLIAARIVELLGHRGWEALKYWWNLLQYWIQELKNSAVNLLNTTAIAVAEGTDRVIEVVQRAYRAILNIPTRIRQGFERALL

SEQ ID NO: 96 - protein, 873 aa, Human immunodeficiency virus 1
MRVKEIRKNCQRLWRWGTMLLGMLMICSAAEQLWVTVYYGVPVWRDANATLFCASDAKAYDTEVHNVWATHASVPTDPNPQEVVLGNVTENFNMWKNDMVEQMHEDVISLWDQSLKPCVKLTPICVTLNCTDYVKNITNNATSTNSSWGEPMEKGEIKNCSFNITTSMKDKVQKTYALFYKLDVVPIDNDSNNNDSTNTNYTNYRLISCNTSVIKQACPKVSFDPIPIHYCTPAGFAILKCRDKKFNGTGPCKNVSTVQCTHGIRPVVPTQLLLNGSLAEEEIVIRSENFSDNAKTIIVHLNESVEINCTRLNNNTRKSIHMGPGRAFYATGEIIGDIRQAHCNISRAKWNNTLKQIAIKLREQFGNNKTIIFKQSSGGDPEIVTHSFNCGGEFFYCNSTQLFNSTWNFNGTWNKNFNNTWNNTEGTNDTITLPCRIKQIINMWQKVGKAMYAPPISGQIRCTSNITGLLLTRDGGNDTSGTEIFRPGGGNMKDNWRSELYKYKVVQIEPLGVAPTEAKRRVVQREKRAVGIGAVFLGFLGAAGSTMGAAAVTLTVQARLLLSGIVQQQNNLLKAIEAQQHLLRLTVWGIKQLQARLLAVERYLGDQQLLGLWGCSGKLICTTAVPWNTSWSNRSLNEIWNNMTWMEWEKEIDNYTNLIYNLLEESQNQQEKNEKELLELDKWANLWNWFDISNWLWYIRIFIMIVGGLIGLRIVFIVLSVVNRVRQGYSPLSLQTRLPTQRGPDRPEGTEEEGGERDRDTSGRLVDGFLAIIWVDLRSLFLFSYHRLRDLLLIVTRIVELLGRRGWEILKYWWNLLQYWGQELKNSAVSLLNATAITVAEGTDRVIEVLQRAGRAILHIPTRIRQGLERILL

SEQ ID NO: 97 - protein, 863 aa, Human immunodeficiency virus 1
MRVKGIRRNYQHLWRWGIMLLGMLMICSATEQLWVTVYYGVPVWKEANTTLFCASDAKAYKTEAHNVWATHASVPTDPNPQEIVLENVTENFNMWKNNMAEQMHEDIINLWDQSLKPCVELTPLCVTLNCTDELKNATFRSNTTTNSSWEKMEKGEIKNCSFNVTTSIRDKMQKEYALFYRLDVVPIDNDNTSYRLISCNTSVITQACPKISFEPIPIHYCVPAGFAILKCNNKTFNGTGPCTNVSTVQCTHGIKPVVSTQLLLNGSLAEEDVVIRSENFTDNTKTIIVQLKEAVEINCTRPNNNTRKGIHIGPGRAFYTTGEIIGNIRQAHCNLSRAKWNDTLKQIVIKLREQFGNKTIVFNQSSGGDVEIVMHSFNCGGEFFYCNTTQLFNSTWNANDIRNVTRGSNRTTGGNDTLILPCRIKQIVNMWQEVGKAMYAPPIKGQIKCSSNITGLLLTRDGGNNGNETNGTEIFRPGGGDMRNNWRSELYKYKVVRIEPLGVAPTKARRRVVQREKRAVTLGAMFLGFLGAAGSTMGAASMTLTVQARLLLSGIVQQQSNLLRAIEAQQRLLQLTVWGIKQLQARILAIERYLKDQQLLGIWGCSGKIICTTAVPWNASWSNKSQDEIWNNMTWMQWEREIDNYTGLIYNLIEESQNQQEKNEQELLALDKWANLWNWFDITKWLWYIKIFIMIVGGLIGLRIVFTVLSIVNRVRKGYSPLSFQTRLPAQRGPDRPEGIEEEGGERDRDRSGPLVDGFLAIFWVDLRSLFLFSYRHLRDLLLIVARIVELLGRRGWELLKYWWNLLQYWSQELKSSAVSLLNATAIAVAEGTDRILEVLQRAYRAILHIPVRIRQGLERALL

SEQ ID NO: 98 - protein, 870 aa, Human immunodeficiency virus 1
MRVKGIRKNYQHLWRWGMMLFGMLMICSAAGNLWVTVYYGVPVWREATTTLFCASDAKAYETEVHNVWATHACVPTDPSPQEVVLENVTEDFNMWKNNMVDQMHEDIISLWDESLKPCVKLTPLCVTLNCTDDVRNVTNNATNTNSSWGEPMEKGEIKFCSFNITTSIRNKVQKQYALFYKLDVIPIDSRNNSNNSTEYNSYRLINCNSSTITQACPKVTFEPIPIHYCAPAGFAILKCNNKKFNGTGPCNNVSTVQCTHGIRPVVSTQLLLNGSLAEKEVVIRSDNFTNNAKTIIVQLNESVVINCTRPNNNTRKRISMGPGRVYYTTGEIIGDIRRAHCNISRAQWNNTLKHIVEKLGKQFGNNKTIFNHSSGGDPEIVMHSFNCRGEFFYCKSTKLFNSTWTRNNGTWTRNDTERSNSTEEHITLPCRIKQIINMWQGVGKAMYAPPIRGQIRCSSNITGLILTRDGGNNDTRGTEIFRPGGGDMKDNWRSELYRYKVVKIEPLGIAPTKAKRRVVQREKRAVGTIGAMFLGFLGTAGSTMGAASLTLTVQARLLLSGIVQQQNNLLRAIEAQQHLLQLTVWGIKQLQAKVLAVERYLRDQQLLGIWGCSGRLICTTNVPWNASWSNKSLDKIWNNMTWMEWDREINNYTSLIYSLIEESQNQQEKNEQDLLALDKWASLWNWFDITNWLWYIKIFIMVVGGLVGLRIIFAVLSIVNKVRQGYSPLSLQTHLPARRGPDRPEGIEGEGGERDRDRSVRLVDGFLALFWDDLRSLCLFLYHRLRDLLLIVTRTVELLGRRGWEALKYCWNLLQYWSQELKNSAVSLFNAIAIAVAEGTDRIIEVVQRICRAIRHIPRRIRQGFERALL

SEQ ID NO: 99 - protein, 859 aa, Human immunodeficiency virus 1
MRVRGIQRNWPQWWIWGILGFWMLMICNVVGNLWVTVYYGVPVWKEAKTTLFCASDAKAYEKEVHNVWATHACVPTDPNPQEIVLENVTENFNMWKNDMVDQMHEDIISLWDQSLKPCVKLTPLCVTLNCTDVKVNATSNGTTTYNNSIDSMNGEIKNCSFNTTTEIRDKKQKVYALFYRLDIVPLDNNSSEYRLINCNTSTITQACPKVSFDPIPIHYCAPAGYAILKCNNKTFNGTGPCNNVSTVQCTHGIKPVVSTQLLLNGSLAEEEIIIRSENLTNNAKTIIVHLNESVEIVCTRPNNNTRKSIRIGPGQTFYATGDIIGDIRQAHCNISEKQWDQTLYRVSEKLKEHFPNKTIKFAPSSGGDLEITTHSFNCRGEFFYCNTSKLFNSTYNSTQMHNDTGSNSTITLPCRIKQIINMWQEVGRAMYAPPIAGNITCKSNITGLLLTRDGGTNNNNTETFRPGGGDMRDNWRSELYKYKVVEIKPLGIAPTKAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSQTDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNPRGPDRLGRIEEEGGEQDRDRSIRLVSGFLALAWDDLRSLCLFSYHRLRDFILVTARAVELLGRSSLRGLQRGWEALKYLGSLVQYWGLELKKSAISLLDTIAIAVAEGTDRIIELIQRICRAIRNIPRRIRQGFEAALL

SEQ ID NO: 100 - protein, 857 aa, Human immunodeficiency virus 1
MRVMGIQRNCQQWWIWGSLGFWMLMIYNVMGNLWVTVYYGVPVWKEAKTTLFCASDAKAYDTEVHNVWATYACVPTDPNPQEMVLENVTENFNMWKNNMVDQMHEDIISLWDQSLKPCVKMTPLCVTLNCSNAKKDNTTIDNEMKGEIKNCSFNITTELRDKKKQVYALFYKLDIVPLNSNSSEYRLINCNTSAITQACPKVSFDPIPIHYCAPAGYAILKCNNETFNGTGPCNNVSTVQCTHGIRPVVSTQLLLNGSLAEKEIIIRSENLTDNVKTIIVHLNESVEINCTRPNNNTRRSIRIGPGQAFYATGEIIGDIRQAYCNISGEKWNETLQRVGKKLKEHFPNKTIKFAPSSGGDLEITTHSFNCRREFFYCNTSGLFNGTYNGNGTYNGTGTDTNSTITIPCRIKQIINMWQEVGRAMYAPPIEGNITCKSNITGLLLVRDGGTENNTETNNTETFRPGGGDMRDNWRSELYRYRVVEIKPLGIAPTKAKRRVVERGKRAVGIGAVFLGFLGVAGSTMGAASITLTVQARQVLSGIVQQQSNLLRAIEAQQHLLQLTVWGIKQLQTRVLAIERYLKDQQLLGIWGYSGKLICTTAVPWNSSWSNRSQEDIWNNMTWMQWDREINNYTNTIYRLLEDSQNQQEKNEQDLLALDSWKNLWNWFDITNWLWYIRIFIMIVGGLIGLRIIFAVLSIVNRVRQGYSPLSLQTLTPNPRELDRLGRIEEGGGEQDRDRSIRLVSGFLALAWDDLRSLCLFSYHRLRDFILIAARAAELLGRSSLKGLQRGWEILKYLGSLIQYWGLELKKSAINLLDTIAIVVAEGTDRIIELIQRICRAICNIPRRIRQGFEAALQ

SEQ ID NO: 101 - protein, 873 aa, Human immunodeficiency virus 1
MRVRGILRNWQQWWIWGILGFWMLMICNVVGNLWVTVYYGVPVWREAKTTLFCASDAKAYEREVHNVWATHACVPTDPNPQELVLENVTENFNMWKNDMVDQMHQDIISLWDESLKPCVKLTPLCVTLKCVNVTKNSNATVNSNATVNNNTMGEEIKNCSFNATTEIRDKKQNVYALFYRLDIVPLNENNDNSSYRLINCNTSTITQACPKVTFDPIPIHYCTPAGYAILKCNDKTFNGTGPCHNVSTVQCTHGIKPVISTQLLLNGSLAEEEIIIRSENLTNNVKTIIVHLNKSVEIVCTRPGNNTRKSVRIGPGQTFYATGDIIGDIRQAHCNISRTAWNKTLQEVGKKLAEHFPNKTIEFKPSSGGDLEVTTHSFNCRGEFFYCNTSKLFNSTYNSTYNSTYNSNSTNSNSNSTITLQCRIKQIINMWQKVGRAIYAPPIAGNITCRSNITGLLLTRDGGNNNDTGNNNDTEIFRPGGGDMKDNWRNELYKYKVVEVKPLGIAPTGAKRRVVEREKRAVGLGAVFLGFLGAAGSTMGAASMTLTVQARQLLSGIVQQQNNLLRAIEAQQHMWQVTVWGIKQLQARVLALERYLKDQQLLGLWGCSGKLICTTNVPWNSSWSNKSLTDIWENMTWMQWDKEISNYTDTIYRLLEVSQNQQEKNEKDLLALDSWNNLWNWFSITKWLWYIKIFIMIVGGLIGLRIIFGVLSIVKRVRQGYSPLSFQTLTPNPRGPDRLGRIEEEGGEQDKDRSIRLVNGFLALAWDDLRNLCLFSYHQLRDFILIVARAVELLGHSSLRGLQRGWEALKYLGSLVQYWGLELKRSAISLLDTTAIAVAEGTDRIIEVIQRICRAIRNIPTRIRQGFEAALLQ

SEQ ID NO: 102 - protein, 848 aa, Human immunodeficiency virus 1
MRVRGIQRNWPQWWIWGILGFWMIIICRVVGNLWVTVYYGVPVWTEAKATLFCASDAKAYEKEVHNVWATHSCVPTDPNPQEIVLGNVTENFNMWENDMVDQMHEDVISLWDQSLKPCVKLTPLCVTLNCTNANVTVNATSDGSIKEEIKNCSFNTTTEIRDKKQKVYALFYRPDIVPLSGSNSSEYILINCNTSTVTQACPKVSFEPIPIHYCAPASYAILKCNNKTFNGTGPCQNVSTVQCTHGIKPVVSTQLLLNGSLAEGEIIIRSENLTNNAKTIIVHLNESIEIVCTRPNNNTRKSIRIGPGQTFFATGDIIGNIRQAHCNISEEKWNKTLQEVSRKLREHFPNKTIIFNSSSGGDLEITTHSFNCGGEFFYCNTTKLFNDSALSAFNKTSNETITLPCRIKQIINMWQGVGRAMYAPPIAGNITCNSSITGLLLTRDGGTNNTEIFRPGGGNMKDNWRSELYKYKVVEIKPLGVAPTEAKRRVVEREKRAVGIGAVLLGFLGAAGSTMGAASITLTAQARQLLSGIVQQQSNLLKAIEAQQHMLQLTVWGIKQLQARVLAIERYLQDQQLLGIWGCSGKLICTTTVPWNSSWSNKSQTDIWDNMTWMQWDREISNYTNTIYRLLEESQNQQEQNEKDLLALDKWQNLWSWFSITNWLWYIKIFIIIVGGLIGLRIILGVLSIVRRVRQGYSPLSFQTLIPNPRGPDRLGGIEEEGGEQDRDRSVRLVSGFLSLAWDDLRSLCLFCYHRLRDFILVTARAVELLGRSSLRGLQKGWEALKYLGNLVQYWGLELKKSAISLLDTIAIAVAEGTDRIIEFIQRICRAIRNIPRRIRQGLEAALQ

SEQ ID NO: 103 - protein, 853 aa, Human immunodeficiency virus 1
MRVRGILRNYQQWWIWGSLGFWMLMIYNVGGNLWVTVYYGVPVWKEAKTTLFCASDAKAYDTEVHNVWATHACVPTDPDPQEIVLENVTENFNMWENDMVDQMHEDIISLWDESLKPCVKLTPLCVTLKCTNVTSTGNTTRGNNTSENREEMKNCSFNTTTEIRDKKQKVYALFYKPDVVPLKENSSEYILINCNTSTVTQACPKVSFDPIPIHYCAPAGFAILKCNNKTFNGTGPCNNVSTVQCTHGIKPVVSTQLLLNGSLAEEEIIIRSENLTDNAKTIIVHLNESIEIVCTRPGNNTRKSIRIGPGQAFYATGDIIGDIRQAYCNISKATWNKTLQEVGKELAKHFPNKTINFNSSSGGDLEITTHSFNCGGEFFYCNTTKLFNNSLLNNTADNSTSTITLQCRIKQIINMWQGVGQAMYAPPIAGNITCKSNITGLLLLRDGGDTSTNGTEIFRPGGGNMKDNWRSELYKYKVVEVKPLGIAPTGAKRRVVEREKRAVGIGAVLLGFLGAAGSTMGAASITLTAQARQVLSGTVQQQSNLLRAVEAQQHMLQLTVWGIKQLQTRVLAIERYLKDQQLLGIWGCSGKLICTTNVPWNSSWSNKSQEEIWENMTWMQWDREISNYTGTIYRLLEESQNQQEKNEQDLLALDSWKNLWNWFDISNWLWYIKIFIIIVGGLIGLRIIFGVLSIVKRVRQGYSPLSFQTLIPNPRGPDRLERIEEEGGEQDRGRSIRLVSGFLAIAWDDLRSLCLFSYHQLRDFILIAVRAVELLGHSSLRGLQRGWEALKYLGSLVQYWGLELKRSAISLLDTIAIVVAEGTDRIIEFIQRICRAIRNIPTRIRQGFEAALQ

SEQ ID NO: 104 - protein, 867 aa, Human immunodeficiency virus 1
MRVMGIQRNCQQWWIWGILGFWILMICNVMGNLWVTVYYGVPVWKEAKATLFCASDAKAYEKEVHNIWATHACVPTDPNPQELVLENVTENFNMWDNDMVDQMHQDIISLWDQSLKPCVKLAPLCVTLNCTNATVTATRNGSDIMNTTSNDGEMKNCSFNVTTELRDKKKKEYALFYRLDIVPLNEGSGNANQNNSNYSDYRLINCNTSAITQACPKVTFDPIPIHYCTPAGYAILKCNDKTFNGTGPCHNVSTVQCTHGIRPVVSTQLLLNGSLAEGEIMIRSENLTNNAKTIIVHLNKSVEIVCTRPNNNTRKSVRIGPGQTFYATNDIIGDIRQAHCNISEEKWNKTLQQVGKKLAEHFPNKTIEFKPSSGGDLEVTTHSFNCRGEFFYCNTSGLFNGTFDGTESNSTSNATITIPCRIKQIINMWQKVGRAIYAPPIAGNITCRSNITGLLLVRDGGNDNKTNDTETFRPGGGDMRDNWRSELYKYKVVEVKPLGVAPTKAKRRVVQREKRAVGIGAVFLGFLGVAGSTMGAASMTLTVQARQVLSGIVQQQSNLLRAIEAQQHLLQLTVWGIKQLQARVLALERYLRDQQLLGMWGCSGKLICTTAVPWNSSWSNKSQEDIWGNMTWMQWDKEISNYTNTIYRLLEDSQNQQERNEKDLLALDSWKNLWSWFDITNWLWYIKIFIMIIGGLIGLRIIFAVLSIVNRVRQGYSPLSLQTLTPNPRGPDRLGRIEEEGGEQDKDRSIRLVNGFLALAWDDLRNLCLFSYHRLRDFILIVARAVELLGRNSLRGLQRGWETLKYLGSLIQYWGLELKKSAISLLDTTAIAVAEGTDRIIELIQRICRAICNIPRRIRQGLEAALQ

SEQ ID NO: 105 - protein, 869 aa, Human immunodeficiency virus 1
MRVRGIQRNWPQWWIWGILGFWMIIICRVVGNLWVTVYYGVPVWREAKTTLFCASNAKAYEKEVHNVWATHACVPTDPNPQEIVLGNVTENFNMWKNDMVDQMHEDVISLWDQSLKPCVKMTPLCVTLNCTDVKVNATSNGTTTYNNSIDSMNGEIKNCSFNTTTELRDKKQKAYALFYRPDIVPLPGKDNSKDNSSEYEEYILINCNSSTITQACPKVSFEPIPIHYCAPASYAILKCNNETFNGTGPCKNVSTVQCTHGIKPVISTQLLLNGSLAEKEIIIRSENLTNNVKTIIVHLKESVEINCTRPNNNTRKSIRIGPGQTFYATGDIIGNIRQAHCNISREKWNTTLKRVKEKLKEHFPNKTIKFAPSSGGDLEITTHTFNCRGEFFYCNTSKLFNSTYVNRTDMNDDTGNNSTITLPCRIKQIINMWQEVGRAMYAPPIAGNITCNSSITGLLLTRDGGNNTENTETFRPGGGNMKDNWRNELYKYKVVEIKPLGVAPTEAKRRVVEREKRAVGLGAVFLGFLGAAGSTMGAASITLTVQARQLLSGIVQQQNNLLRAIEAQQHMLQLAVWGIKQLQARVLAIERYLQDQQLLGIWGCSGKLICTTSVPWNSSWSNRSQEDIWNNMTWMQWDREISNYTDTIYRLLEVSQNQQEQNEKDLLALDKWQNLWSWFSITNWLWYIRIFIMIVGGLIGLRIVFAVLSLVNRVRQGYSPLSFQTLTPSPRGPDRLGGIEEEGGEQDRDRSIRLVSGFLSLAWDDLRSLCLFSYHRLRDFILIAARAAELLGRSSLRGLQRGWEILKYLGSLAQYWGLELKKSAINLLDTIAIAVAEGTDRIIEVIQRICRAIYNIPRRIRQGFEASLL

SEQ ID NO: 106 - protein, 849 aa, Human immunodeficiency virus 1
MRVRGIPRNWQQWWIWGILGFWMLMICNVVGNLWVTVYYGVPVWTEAKTTLFCASDAKAYEREVHNVWATYACVPTDPNPQEMVLENVTENFNMWKNDMVEQMHEDIISLWDQGLKPCVKLTPLCVTLNCSNAKKDNTTIDNEMKGEIKNCSFNITTELRDKKQQVYALFYKLDIVPLNSNSSEYRLINCNTSTITQACPKVNFDPIPIHYCAPAGYAILKCNNKTFNGTGPCQNVSTVQCTHRIKPVVSTQLLINGSLAEGEIIIRSENLTDNVKTIIVHLNESVEIVCTRPNNNTRKSMRIGPGQTFYATGEIIGDIRQAHCNISKEKWNNTLQEVREKLREHFPNKTIKFAPHSGGDPEITTHSFNCRGEFFYCNTSQLFNSTYNSTQMHNDTGSNSTITLPCKIKQIINMWQGVGRAMYAPPIEGNITCTSNITGLLLTRDGGTNNTEIFRPGGGDMRNNWRSELYKYKVVEIKPLGIAPTKAKRRVVERGKRAVGIGAVLFGFLGAAGSTMGAASIALTAQARQLLSGIVQQQSNLLKAIEAQQHMWQVTVWGIKQLQARVLAMERYLKDQQLLGLWGCSGKLICTTTVPWNSSWSNKSQTDIWDNMTWMQWDREINNYTNTIYKLLEDSQNQQEKNEKDLLALDSWNNLWNWFSITKWLWYIKIFIMIVGGLIGLRIILGVLSIVRRVRQGYSPLSFQTLTPNPRELDRLGRIEEGGGEQDRDRSVRLVSGFLALAWDDLRSLCLFCYHRLRDFILVTARAVELLGRSSLKGLQRGWEALKYLGNLVQYWGLELKKSAISLFDTIAITVAEGTDRIIELVQRICRAIRNIPRRIRQGFEAALL

SEQ ID NO: 107 - protein, 874 aa, Human immunodeficiency virus 1
MRVRGIQRNWPQWWIWGILGFWIIIMCRVMGNMWVTVYYGVPVWREAKTTLFCASDAKGYEKEVHNAWATHACVPTGPNPQEMVLENVTENFNMWKNNMVDQMHEDIINLWDQSLKPCVRLTPLCVTLKCVNVTKNSNATVNSNATVNNNTMGEEIKNCSFNATTEIRDKKQKAYALFYRPDIVPLNENSSSENNSSEYILINCNTSTITQACPKVSFDPIPIHYCAPASYAILKCNNETFNGTGPCQNVSTVQCTHGIKPVISTQLLLNGSLAEEDIIIRSENLTNNAKTIIVHLNQSVEIVCTRPGNNTRKSMRIGPGQTFYATNDIIGNIRQAHCNISEGKWNETLLRVKKKLEEHFPNKTIKFEPSSGGDLEITTHTFNCRGEFFYCDTSTLFNHTYVSAYMNNTDVSADRKNDTQSNSTITLPCRIRQIINMWQEVGRAIYAPPIAGNITCRSNITGLLLVRDGGNTTNSTETFRPEGGNMKDNWRSELYKYKVVEIRPLGIAPTGAKRRVVEREKRAVGIGAVFLGFLGVAGSTMGAASMTLTVQARQVLSGVVQQQSNLLQAIEAQQHLLQLTVWGIKQLQTRVLALERYLRDQQLLGIWGCSGKIICTTAVPWNTSWSNKSQEDIWNNMTWMQWDREINNYTNTIYKLLEESQNQQEKNEQDLLALDSWNSLWNWFSITKWLWYIRIFIIIVGSLIGLRIIFGVLSIVKRVRQGYSPLLSQTLTPNPREPDRLGRIEEGGGEQDRDRSVRLVNGFLALVWDDLRSLCLFCYHRLRDFILVTARVVELLGRSSLRGLQKGWEALKYLGSLVQYWGLELKKSAINLLDTIAIAVGEGTDRIIEVIQRICRAIYNIPRRIRQGFEASLL

SEQ ID NO: 108 - protein, 869 aa, Human immunodeficiency virus 1
MRVRGILRNYQQWWIWGSLGFWMLMIYNVGGNLWVTVYYGVPVWTDAKTTLFCASDAKAYDKEVHNVWATHACVPTDPNPQELVLENVTENFNMWKNDMVNQMHEDIISLWDESLKPCVKLTPLCVTLNCTNATVTATRNGSDIMNTTSNDGEMKNCSFNITTELRDKKRKEYALFYRLDIVPLDENNSSEKSSENSSEYYRLINCNTSAITQACPKVTFDPIPLHYCAPAGYAILKCKDKTFNGTGPCSNVSTVQCTHGIKPVVSTRLLLNGSLAEGEIIIRSENLTNNVKTIIVHLKEPVEINCTRPNNNTRESIRIGPGQTFYATGDIIGDIRQAHCNISREKWNKTLQEVGKKLAEHFPNKTIKFAPHSGGDLEITMHSFNCRGEFFYCNTSGLFNGTYMPTYMPNGTESNSNSTITIPCRIKQIINMWQEVGRAMYAPPIEGNITCNSNITGLLLVRDGGINKTNNTETFRPGGGDMRNNWRSELYKYKVVEIKPLGVAPTEAKRRVVEREKRAALGAMFLGFLGAAGSNMGAASITLTAQARQLLSGIVQQRSNLLRAIEAQQHLLQLTVWGVKQLQARVLAMERYLKDQQLLGLWGCSGKLICTTSVPWNSSWSNRSQEEIWNNMTWMEWDREISNYTNTIYRLLEDSQNQQEKNEKDLLALDSWKNLWSWFDITNWLWYIKIFIMIIGGLIGLRIVFAVLSIVNRVRQGYSPLSFQTLTPSPRGPDRLGRIEEEGGEQDKDRSVRLVSGFLSLAWDDLRSLCLFSYHRLRDLILIAARAVELLGHSSLRGLQRGWEILKYLGSLAQYWGLELKRSAISLLDTIAITVAEGTDRIIEIIQRICRAICNIPRRIRQGFETALL

SEQ ID NO: 109 - protein, 849 aa, Human immunodeficiency virus 1
MRVMGILRNCQQWWIWGVLGFWMLMICNVVGNLWVTVYYGVPVWKEAKTTLFCASNAKAYEREVHNIWATHACVPTDPNPQEMVLKNVTENFNMWKNDMVDQMHEDVISLWDQSLKPCVKLAPLCVTLNCTNVTVNDTLHQNFTDMKNCSFNVTTELRDKKQKVYALFYRLDVVPLGDNNSSYRLINCNTSTIAQACPKVNFDPIPIHYCTPAGYAILKCNDKTFNGTGPCKNVSTVQCTHEIKPVVSTQLLLNGSLAEEGIIIRSENLTDNAKTIIVHLNESVEINCTRPGNNTRQSIRIGPGQAFYATGAIIGDIRQAHCNISKDEWEKTLKRVSEKLKEHFPNKTIEFKPSSGGDLEVTTHSFNCRREFFYCNTSKLFNSTYNSTQMHNDTGSNSTITLPCKIKQIINMWQGVGQAMYAPPIKGNITCKSNITGILLTRDGGNLTNGTETFRPGGGDMKDNWRSELYRYRVVEIKPLGIAPTKAKRRVVQREKRAVGIGALFLGFLGTAGSTMGAASLTLTVQARQLLSSIVQQQSNLLRAIEAQQHMLQLTIWGIKQLQTRVLAVERYLKDQQLLGMWGCSGKLICTTAVPWNASWSNKSQEEIWGNMTWMQWDREISNYTDIIYRLLEESQNQQERNEKDLLALDSWNNLWNWFNITNWLWYIKIFIMIVGGVIGLRIIFAVLSLVNRVRQGYSPLSFQTLTPNPRELDRLGRIEEEGGEQGRDRSIRLVNGFLAIAWDDLRSLCLFSYRRLRDFILIAARAAELLGRSSLRGLQRGWETLKYLGSLIQYWGLELKKSAISLFDTIAIAVAEGTDRIIELIQRICRAIRNIPRRIRQGLEAALQ

SEQ ID NO: 110 - protein, 855 aa, Human immunodeficiency virus 1
MRVMGIQRNCQQWWIWGILGFWMLMIYNVVGNLWVTIYYGVPVWKEAKATLFCASDAKAYDTEVHNVWATHACVPTDPDPQEMVLGNVTENFNMWKNDMADQMHEDIISLWDQGLKPCVKLTPLCVTLHCTNTNITNENRTIGDKLNEEMKNCSFNTTTELRDKKQQVYALFYKPDVVPLNGGEHNETGEYILINCNSSTITQACPKVSFEPIPIHYCAPAGFAILKCNNKTFNGTGPCHNVSTVQCTHGIRPVVSTQLLLNGSLAEEEIIIRSENLTDNVKTIIVHLNKSVEIVCTRPNNNTRKSIRIGPGQTFFATNDIIGDIRQAYCNISAEKWNKTLERVEEKLKEHFPNKTIKFNSSSGGDLEITTHSFNCRGEFFYCNTSNLFNGTYHGTQSTNSTNSTITLQCRIKQIINMWQKVGRAMYAPPIAGNITCKSNITGLLLLRDGGTENNDTETFRPGGGNMRDNWRSELYKYKVVEVKPLGIAPTTAKRRVVERDKRAVGIGAVLLGFLGAAGSTMGAASMALTVQARQLLSGIVQQQSNLLRAVEAQQHMLQLTVWGIKQLQARVLALERYLKDQQLLGIWGCSGRLICTTAVPWNSSWSNKTQGEIWENMTWMQWDKEINNYTNTIYRLLEESQTQQEQNEKDLLALDSWKNLWNWFDITKWLWYIKIFIMVVGGLIGLRIIFAVLSIVNSVRQGYSPLSLQTLTPNPRGPDRLERIEEEGGEQDRNRSIRLVNGFLALAWDDLRSLCLFSYHHLRDFILVTARAVELLGRSSLKGLQRGWEALKYLGNLVQYWGLELKKSAISLLDTTAIAVAEGTDRIIELVQRICRAILNIPTRIRQGFEAALQ

SEQ ID NO: 111 - protein, 861 aa, Human immunodeficiency virus 1
MRVRGIPRNWPQWWTWGILGFWMIIICRVVGNLWVTVYYGVPVWTEAKTTLFCASDAKAYEREVHNVWATHSCVPTDPNPQEIVLGNVTENFNMWENDMVDQMHQDIISLWDQSLKPCVKMTPLCVTLNCSNAKKDNTTIDNEMKGEIKNCSFNITTEIRDKKQKVHALFYRLDIVPLNEGSGNANQNNSNYSDYRLINCNTSTVTQACPKVTFDPIPIHYCAPARYAILKCNNNTFNGTGPCNNVSTVQCTHGIKPVVSTQLLLSGSLAEEEIVIRSENLTNNAKIIIVHLNESVEIVCTRPNNNTRRSIRIGPGQTFYATGEIIGDIRQAHCNISAKQWNTTLERVKEKLREHFPNKTIKFEPHSGGDPEITTHSFNCGGEFFYCNTSQLFNSTYNSTYMSNNTGENSNETITLPCRIKQIINMWQQVGRAMYAPPIAGNITCNSSITGLLLTRDGGNNNDTGNNNDTEIFRPGGGDMRDNWRSELYKYKVVELKPLGIAPTEAKRRVVKREKRAVGIGAVLFGFLGAAGSTMGAASIALTAQARQVLSGIVQQQNNLLRAIEAQQHVLQLTVWGIKQLQTRVLAIERYLKDQQLLSLWGCSGKLICTTTVPWNSSWSNKSLTDIWDNMTWMQWDREISNYTGTIYRLLEDSQSQQEKNEKDLLELDKWNNLWNWFDISNWLWYIKIFIIIVGGLIGLRIIFAVLSIINRVRQGYSPLLFQTLTPNPRGLDRLGRIEEEGGEQDKDRSIRLVNGFLALAWEDLRSLCLFSYHQLRDFILIVARAVELLGRRGWEALKYLGNLVLYWGLELKKSAVSLLDTIAIAVAGGTDRIIEVVQRICRAIRNIPTRIRQGLEAALL

SEQ ID NO: 112 - protein, 851 aa, Human immunodeficiency virus 1
MRVRGILRNWQQWWIWGILGFWMVMICNVMGNLWVTVYYGVPVWQEAKTTLFCASDAKAYEKEVHNVWATHACVPTDPSPQEIVLENVTENFNMWKNDMVEQMHEDIISIWDQSLKPCVTLTPLCVTLNCTDVKVNATSNGTTTYNNSIDSMNGEIKNCSFNTTTEIRDKKKQVYALFYKLDIVPLNSNSSEYRLINCNTSAVTQACPKVSWDPIPIHYCAPAGYAILKCNNKTFNGTGPCTNVSTVQCTHRIKPVVTTQLLLNGSLAEKEIIIRSENLTNNIKTIIVHLNESIEIVCTRPNNNTRKSVRIGPGQTFFATGDIIGDIRKAHCNISEDKWNETLQRVGKKLVEHFPNKTIKFAPSSGGDLEVTTHSFNCKGEFFYCNTTKLFDDSERINTTTTTIILPCRIKQFINMWQGVGRAMYAPPIAGNITCTSNITGLLLTRDGGTNNTEIFRPGGGNMKDNWRNELYKYKVVEVKPLGVAPTKAKRRVVEREKRAVGLGAVFLGFLGAAGSTMGAASITLTVQARQLLFGIVQQQSNLLKAIEAQQHMWQVTVWGIKQLQARVLAIERYLQDQQLLGIWGCSGKLICTTNVPWNSSWSNKSQTDIWDNMTWMQWDKEISNYTDTIYRLLEVSQNQQEENEKDLLALDKWQNLWNWFSITNWLWYIRIFIMIVGGLIGLRIILGVLSIVRRVRQGYSPLSFQTLIPNPRGPDRLGGIEEEGGEQDRDRSIRLVSGFLALAWDDLRNLCLFSYHRLRDFILIVVRAVELLGRNSLRGLQRGWEALKYLGSLGQYWGLEIKKSAISLLDTIAIVVAEGTDRIIEFIQRFCRAIRNLPRRIRQGFEAALL

SEQ ID NO: 113 - protein, 871 aa, Human immunodeficiency virus 1
MRVTGIRKNYQHLWRWGTMLLWRWGTMLLGMLMICSAAGNLWVTVYYGVPVWKEATTTLFCASDAKAYDTEVHNVWATHACVPTDPNPQEVVLENVTENFNMWKNNMVEQMHEDIISLWDQSLKPCVKLTPLCVTLNCTDDVRNVTNNATNTNSSWGEPMEKGEIKNCSFNITTSIRDKVQKEYALFYKLDVVPIDNDSNNTNYRLISCNTSVITQACPKVSFEPIPIHYCAPAGFAILKCNDKKFNGTGPCTNVSTVQCTHGIKPVVSTQLLLNGSLAEEEVVIRSENFTNNAKTIIVQLNESVEINCTRPNNNTRKSIRIGPGQTFYATGDIIGDIRQAHCNISRAQWNNTLKHIVEKLGKQFGNNKTIVFNHSSGGDPEIVMHSFNCGGEFFYCNTTKLFNSTWTRNNGTWTRNDTERSNSTEEHITLPCRIKQIINMWQEVGKAMYAPPIRGQIRCSSNITGLLLTRDGGNDTSGTEIFRPGGGDMRDNWRSELYKYKVVKIEPLGVAPTKAKRRVVQREKRAVGIGAVFLGFLGAAGSTMGAASITLTVQARQLLSGIVQQQNNLLRAIEAQQHLLQLTVWGIKQLQARVLAVERYLKDQQLLGIWGCSGKLICTTAVPWNSSWSNKSLNEIWNNMTWMEWEREIDNYTGLIYTLIEESQNQQEKNEQELLELDKWASLWNWFDISNWLWYIKIFIMIVGGLIGLRIVFAVLSIVNRVRQGYSPLSFQTRLPAPRGPDRPEGIEEEGGERDRDRSIRLVSGFLALAWDDLRSLCLFSYHRLRDLLLIVTRIVELLGRRGWEALKYWWNLLQYWSQELKNSAVSLLNATAIAVAEGTDRVIEALQRACRAILHIPRRIRQGLERALL

SEQ ID NO: 114 - protein, 862 aa, Human immunodeficiency virus 1
MRVRGIQRNWPQWWIWGILGFWMLMICNVVGNLWVTVYYGVPVWKEAKTTLFCASDAKAYEKEVHNVWATYACVPTDPNPQEIHLENVTEEFNMWKNDMVDQMHEDIISLWDQSLKPCVQLTPLCVTLNCTNVNVTNLKNETNTKSSSGGEKMEEGEMKNCSFNITTSIRDKVQKEYALFYKLDVVPIDNDSNNTNYRLISCNTSVITQACPKVTFEPIPIHYCTPAGFAILKCKDKKFNGTGPCKNVSTVQCTHGIKPVISTQLLLNGSLAEEEIIIRSENITNNAKTIIVQLNESVEINCTRPGNNTRKSVRIGPGQTFYATGEIIGDIRQAHCNLSRAKWNDTLKQIVIKLREQFGNKTIVFNQSSGGDPEIVMHSFNCGGEFFYCNTTQLFNSTWNSTSLFNSTNGTITLQCRIKQIINMWQEVGKAMYAPPIEGNITCKSNITGLLLVRDGGTEPNDTETFRPGGGNMKDNWRSELYKYKVVKIEPLGVAPTKAKRRVVQREKRAVGTIGAMFLGFLGAAGSTMGAASMTLTVQARLLLSGIVQQQNNLLRAIEAQQHLLQLTVWGIKQLQARILAVERYLKDQQLLGLWGCSGKLICTTAVPWNTSWSNKSQTDIWDNMTWMEWEREIDNYTGLIYTLIEESQNQQEKNEQELLELDKWASLWNWFDITKWLWYIKIFIMIVGGLVGLRIVFAVLSIVNRVRKGYSPLSFQTLTPNPRGPDRLGRIEEEGGEQDRDRSIRLVSGFLALAWDDLRSLCLFSYHQLRDFILIVARAVELLGRSSLRGLQRGWEALKYLGSLVQYWGLELKKSAISLLDTIAIAVAEGTDRIIEVIQRICRAIRNIPRRIRQGFERALL

SEQ ID NO: 115 - protein, 869 aa, Human immunodeficiency virus 1
MRVTGIRKNYQHLWRWGTMLLWRWGTMLLGILMICSAAGKLWVTVYYGVPVWRDAETTLFCASDAKAHETEVHNIWATHACVPTDPNPQEVVLGNVTENFNMWKNNMVEQMHEDIISLWDESLKPCVKLTPICVTLNCTDDVRNVTNNATNTNSSWGEPMEKGEIKNCSFNMTTELRDKKQKVHALFYKLDIVPLNSNSSEYRLINCNTSAITQACPKVSFEPIPIHYCAPAGFAILKCNDKKFNGTGPCTNVSTVQCTHGIRPVVSTQLLLNGSLAEEEVVIRSENFTNNAKTIMVQLNVSVEINCTRPNNNTRKSIHIGPGRAFYTTGDIIGDIRQAHCNISRAQWNNTLKHIVEKLGKQFGNNKTIVFNHSSGGDPEITTHSFNCGGEFFYCNSTKLFNSTWTRNNGTWTRNDTERSNSTEEHITLPCRIKQIVNMWQRVGQAMYAPPIRGQIRCSSNITGLLLTRDGGNDTSGTEIFRPGGGDMRNNWRNELYKYKVVRIEPLGVAPTRAKRRVVEREKRAVGLGAVFLGFLGAAGSTMGAASLTLTVQARQVLSGIVQQQSNLLKAIEAQQHLLKLTVWGIKQLQARVLAVERYLRDQQLLGIWGCSGKLICTTTVPWNASWSNKSLNEIWNNMTWMEWEKEIDNYTNLIYNLLEESQNQQEKNEQDLLALDKWANLWNWFDISNWLWYIKIFIIIVGGLIGLRIVFAVLSIINRVRQGYSPLSLQTLIPNPRGPDRPGGIEEEGGEQGRDRSIRLVNGFLALAWDDLRNLCLFSYHRLRDLLLIVTRIVELLGRRGWEALKYWWNLLQYWSQELKNSAISLLNATAVAVAEGTDRVIEALQRACRAILHIPRRIRQGLERLLL

SEQ ID NO: 116 - protein, 862 aa, Human immunodeficiency virus 1
MRVKETRKNYQHLWKWGTMLLGMLMICSAAEQLWVTVYYGVPVWKEATTTLFCASDAKAYDTEVHNVWATHACVPTDPSPQEVVLENVTENFNMWKNDMVEQMHTDIISLWDQSLKPCVKLTPLCVTLNCTDYVKNITNNATSTNSSWGKPMEKGEIKNCSFNITTSIRNKVQKQYALFYKLDIVPIDNDNTSYRLINCNTSTITQACPKVSFDPIPIHYCAPAGYAILKCNNKTFNGTGPCNNVSTVQCTHGIKPVVSTQLLLNGSLAEGEIIIRSENLTNNAKTIIVHLNKSVEINCTRPSNNTRKSIRIGPGQAFYATGDIIGDIRKAHCNISGTKWNHTLEQVMEELKKHFPNKTIKFNSSSGGDLEITTHSFNCRGEFFYCNTSGLFNSTWNDTTINRTEGSNNTRNITLPCRIKQIINMWQGVGRAMYAPPIAGNITCKSNITGILLTRDGGNNNSTNETFRPGGGDMRDNWRSELYKYKVVEIKPLGIAPTKAKRRVVEREKRAVGIGAVFLGFLGTAGSTMGAASITLTVQARQLLSGIVQQQSNLLRAIEAQQHMLQLTVWGIKQLQTRVLAIERYLKDQQLLGIWGCSGKLICTTNVPWNSSWSNKSQSEIWDNMTWMQWDREISNYTDTIYRLLEDSQNQQEKNEKDLLALDSWKNLWNWFDITNWLWYIRIFIMIVGGLIGLRIIFAVLSIVNRVRQGYSPLSFQTRLPAPRGPDRPEGIEEEGGERDRDRSVRLVDGFLALIWDDLRSLCLFSYHRLRDFILIAARTVELLGHSSLKGLRLGWEGLKYLWNLLQYWIQELKNSAVSLLNATAIAVAEGTDRVIEVVQRAYRAILHIPTRIRQGLERALL

SEQ ID NO: 117 - protein, 852 aa, Human immunodeficiency virus 1
MRVKETRKNYQHLWKWGTMLLGMLMICSAAEQLWVTVYYGVPVWKEATTTLFCASDAKAHETEVHNIWATHACVPTDPNPQEVVLGNVTENFNMWKNDMVEQMHTDIISLWDQSLKPCVELTPLCVTLHCTDLGNATNTMEKGEIKNCSFNMTTELRDKKQKVYALFYRLDIVPIDNDNTSYRLINCNTSVIKQACPKVTFEPIPIHYCTPAGFAILKCNDKNFNGTGPCKNVSTVQCTHGIRPVVSTQLLLNGSLAEKEIIIRSENLTDNAKTIIVHLNKSVEINCTRPSNNTRKSVRIGPGQTFYATGDIIGDIRQAHCNISRAKWNNTLKQIVTKLREQFKNKTIVFNQSSGGDLEITTHSFNCRGEFFYCNTTQLFNSTWKNDTEVSNNTKGNDTITLPCRIKQIVNMWQEVGRAMYAPPIEGNITCNSNITGILLTRDGGNNGNETNGTEIFRPGGGNMRDNWRNELYKYKVVEIKPLGVAPTEAKRRVVEREKRAVGIGAVFLGFLGAAGSTMGAASITLTVQARQLLTGIVQQQSNLLRAIEAQQHMLQLTVWGIKQLQTRVLAIERYLKDQQLLGLWGCSGKLICTTAVPWNSSWSNKTYNDIWDNMTWMQWDREISNYTDTIYRLLEDSQNQQEKNEKDLLALDSWKNLWNWFDITNWLWYIKIFIMIVGGLIGLRIIFAVLSIVNRVRQGYSPLSFQTLTPNPRGPDRPGGIEEEGGEQGRDRSIRLVNGFLALAWDDLRNLCLFSYHQLRDFILIVARAVELLGRSSLRGLQRGWEALKYLGSLVQYWGLELKKSAISLLDTIAIAVAEGTDRVIEVVQRAYRAILHIPTRIRQGLERLLL

SEQ ID NO: 118 - protein, 862 aa, Human immunodeficiency virus 1
MRVRGIQRNWPQWWIWGILGFWMLMICNVVGNLWVTVYYGVPVWKEAKTTLFCASDAKAYEKEVHNVWATHACVPTDPSPQEVVLENVTENFDMWKNNMVEQMQEDVISLWDQSLKPCVKLAPLCVTLNCTDYVKNITNNATSTNSSWGKPMEKGEIKFCSFNITTSIRNKVQKQYALFYKLDVVQMDEDNTSYRLISCNTSTITQACPKVTFDPIPIHYCAPAGFAILKCNNKTFNGTGPCTNVSTVQCTHGIKPVVSTQLLLNGSLAEEEIIIRSENLTNNAKTIIVHLNESVEIVCTRPNNNTRKSIHIGPGRAFYATGEIIGDIRQAHCNLSRAKWNDTLKQIVIKLREQFGNKTIIFNQSSGGDPEITTHSFNCGGEFFYCNSTQLFNSTWNFNGTWNKNFNNTWNNTEGTNDTITLPCKIKQIINMWQRVGQAMYAPPISGQIRCSSNITGLILTRDGGNDTSGTEIFRPGGGDMRDNWRSELYKYKVVKIEPLGVAPTKAKRRVVQREKRAVGIGALFLGFLGAAGSTMGAASMTLTVQARQLLSGIVQQQSNLLKAIEAQQHLLQLTVWGIKQLQARILAVERYLKDQQLLGIWGCSGKLICTTTVPWNASWSNKSLNEIWDNMTWMEWEREIDNYTGLIYNLIEESQTQQEKNEQELLELDKWASLWNWFDITKWLWYIKIFIMIIGGLIGLRIVFTVLSIVNRVRKGYSPLSFQTLTHHQREPDRPERIEEGGGEQDRDRSGRLVDGFLAIIWVDLRSLCLFSYHRLRDLLLIVTRIVELLGRRGWEVLKYWWNLLQYWSQELKNSAVSLLNATAIAVAEGTDRIIEVIQRICRAIRNIPRRIRQGLERALL

SEQ ID NO: 119 - protein, 870 aa, Human immunodeficiency virus 1
MRVKETQMNWPNLWKWGTLILGLVIICSASDNLWVTVYYGVPVWKDAETTLFCASDAKAYDTEVHNVWATYACVPTDPNPQEIHLENVTEEFNMWKNDMVDQMHEDIISLWDESLKPCVKLTPLCVTLNCTDDVRNVTNNATNTNSSWGEPMEKGEIKNCSFNITTSIRDKVQKEYALFYKLDVVPIDNDSNNTNYRLISCNTSVITQACPKVSFEPIPIHYCAPAGYAILKCNDKKFNGTGPCNNVSTVQCTHGIKPVVTTQLLLNGSLAEGEIIIRSENITNNAKTIIVQLNESVVINCTRPNNNTRKSIRIGPGQAFYATGDIIGNIRQAHCNISRANWNNTLRQIVEKLGEQFGNNKTIVFNHSSGGDPEIVTHSFNCAGEFFYCNTTKLFNSTWTRNNGTWTRNDTERSNSTEEHITLPCRIKQIINMWQEVGKAMYAPPIRGQIRCSSNITGLLLTRDGGNNNSTNETFRPGGGNMKDNWRSELYKYKVVQIEPLGIAPTKAKRRVVEREKRAVGLGAVFLGFLGTAGSTMGAASLTLTVQARQVLSGIVQQQRNLLRAIEAQQHLLKLTVWGIKQLQARVLAIERYLQDQQLLGMWGCSGKLICTTNVPWNSSWSNKSQTDIWDNMTWLQWDKEISNYTSLIYTLIEESQNQQEKNEQDLLALDKWASLWSWFDISNWLWYIKIFIIIVGGLIGLRIVFAVLSIINRVRQGYSPLSLQTLIPNPRGPDRLGRIEEEGGEQDRDRSIRLVSGFLALAWDDLRSLCIFSYHRLRDFILIAARTVELLGHSSLKGLRLGWEGLKYLGNLLLYWGQELKNSAINLLDTIAIAVAGWTDRVIEIGQRAGRAILNIPRRIRQGFERALL

SEQ ID NO: 120 - protein, 861 aa, Human immunodeficiency virus 1
MRVTGIRKNYQHLWRWGTMLLWRWGTMLLGILMICSAAGKLWVTVYYGVPVWRDADTTLFCASDAKAYDTEAHNVWATHASVPTDPNPQEIVLENVTENFNMWKNNMVEQMHEDIISLWDQSLKPCVQLTPLCVTLNCTNVNVTNLKNETNTKSSSGGEKMEEGEMKNCSFNITTEIRDKKQKVHALFYKLDIVPLNSNSSEYRLINCNTSAITQACPKVSFDPIPIHYCTPAGYAILKCNNKKFNGTGPCKNVSSVQCTHGIKPVISTQLLLNGSLAEEEVVIRSENFTNNAKTIMVQLNVSVEINCTRPNNNTRRSIPIGPGRAFYTTGDIIGDIRKAHCNISRAQWNNTLKHIVEKLGKQFGNNKTIIFKPSSGGDPEIVMHSFNCGGEFFYCNTSGLFNSTWNSTSLFNSTNGTITLQCRIKQIINMWQGVGRAMYAPPIAGNITCKSNITGLLLVRDGGTEPNDTETFRPGGGDMKDNWRSELYKYKVVRIEPLGVAPTRAKRRVVEREKRAIGLGAMFLGFLGAAGSTMGAASVTLTVQARLLLSGIVQQQNNLLRAIEAQQHLLRLTVWGIKQLQARVLAVERYLRDQQLLGIWGCSGKIICTTAVPWNTSWSNRSLNEIWNNMTWMEWEKEIDNYTNLIYNLLEESQNQQEKNEQELLALDKWANLWNWFDISNWLWYIRIFIMIVGGLVGLRIVFAVLSIVKRVRQGYSPLSFQTRLPAPRGPDRPEGIEEEGGERDRDRSVRLVDGFLALIWDDLRSLCLFSYHHLRDLLLIVARIVELLGRRGWEALKYWWNLLQYWIQELKNSAISLLNATAVAVAEGTDRVIEALQRACRAILHIPRRIRQGFEAALL

SEQ ID NO: 121 - protein, 866 aa, Human immunodeficiency virus 1
MRVMGIQRNCQQWWIWGILGFWMLMICNVMGNLWVTVYYGVPVWKEANTTLFCASDAKAYEREVHNVWATHASVPTDPNPQEVVLENVTEDFNMWKNNMVEQMQEDVISLWDQSLQPCVKLTPLCVTLNCTDLRNATNGNDTNTTSSSREMMGGGEMKNCSFNITTEIRDKKQKVYALFYKLDVVPIDNDSNNTNYRLISCNTSAVTQACPKVTFDPIPIHYCTPAGFAILKCRDKKFNGTGPCNNVSTVQCTHGIKPVVTTQLLLNGSLAEEEIVIRSENFTDNAKTIIVQLKEAVEINCTRPNNNTRKGIHIGPGRAFYATGEIIGDIRQAHCNVSRSEWNKTLQQVATQLRKHFNKTIIFNSSSGGDLEITTHSFNCRGEFFYCNTSGLFNSTWNDTTINRTEGSNNTRNITLPCRIKQFINMWQEVGRAMYAPPIAGNITCRSNITGLLLTRDGGNNGNETNGTEIFRPGGGDMRNNWRSELYKYKVVEIKPLGIAPTKARRRVVQREKRAVGIGAVFLGFLSAAGSTMGAASITLTVQARQLLTGIVQQQSNLLKAIEAQQHMLQLTVWGVKQLQARVLAVERYLRDQQLLGIWGCSGRLICTTAVPWNTSWSNKSLNEIWDNMTWMEWEREIDNYTSLIYTLIEESQNQQEKNEQELLELDKWANLWNWFSITNWLWYIRIFIMIVGGLIGLRIIFGVLSIVKRVRQGYSPLSFQTRLPAPRGPDRPEGIEEEGGERDRDRSGRLVDGFLALIWDDLRSLCLFSYHRLRDLILIAARIVELLGHSSLKGLRLGWEALKYLWNLLLYWGQELKNSAISLLNTTAIVVAEGTDRVIEVLQRAGRAILNIPRRIRQGFEAALL

SEQ ID NO: 122 - protein, 864 aa, Human immunodeficiency virus 1
MRVTGIRKNYQHLWRWGTMLLWRWGTMLLGILMICSAAGKLWVTVYYGVPVWREAKTTLFCASDAKAYEKEVHNVWATYACVPTDPNPQEMVLENVTENFNMWKNNMVDQMHEDIISLWDESLKPCVKLTPLCVTLHCTDLGNATNTMEKGEIKNCSFNTTTEIRDKKQKVHALFYRLDVVPIDNDNTSYTLINCNTSVITQACPKVTFEPIPIHYCAPAGFAILKCNNKKFNGTGPCTNVSTVQCTHGIRPVVSTQLLLNGSLAEGEIIIRSENLTDNAKTIIVHLNESVEIVCTRPNNNTRKSVRIGPGQTFYATGAIIGDIRQAYCNISRAKWNNTLKQIVTKLREQFGNNKTIIFKPPSGGDLEITMHHFNCRGEFFYCNTTQLFNSTWNFNGTWNKNFNNTWNNTEGTNDTITLPCKIKQIINMWQGVGRAMYAPPISGQIRCSSNITGLLLTRDGGTNNTEIFRPGGGNMRDNWRSELYKYKVVKIEPLGVAPTKAKRRVVQREKRAVGIGALFLGFLGAAGSTMGAASMTLTVQARQVLSGIVQQQRNLLRAIEAQQHLLQLTVWGIKQLQARILAVERYLKDQKFLGLWGCSGKIICTTAVPWNASWSNKSLDDIWNNMTWMQWEREIDNYTGLIYSLIEESQTQQEKNEQELLQLDKWASLWNWFDITNWLWYIRLFIMIVGGLVGLRIVFTVLSIVNRVRKGYSPLSFQTLTHHQREPDRPERIEEGGGEQGRDRSVRLVSGFLALFWDDLRSLCLFCYHRLRDFILIAARTVELLGHSSLKGLRRGWEGLKYLWNLLQYWIQELKNSAISLLNATAVAVAEGTDRVIEALQRACRAILHIPRRIRQGLERLLL

SEQ ID NO: 123 - protein, 871 aa, Human immunodeficiency virus 1
MRVRGIQRNWPQWWIWGILGFWMIIICRVVGNLWVTVYYGVPVWKDAETTLFCASDAKSYETEAHNIWATHACVPTDPSPQEVVLGNVTENFNMWKNDMVEQMHEDIISLWDQSLKPCVELTPLCVTLNCTDDVRNVTNNATNTNSSWGEPMEKGEIKNCSFNITTSIRNKVQKQYALFYKLDVVQIDDNNSTNTSYRLINCNTSAITQACPKVSFDPIPIHYCAPAGYAILKCNNKTFNGTGPCHNVSTVQCTHGIRPVISTQLLLNGSLAEEEVVIRSENFTNNAKTIMVQLNVSVEINCTRPNNNTRKSIHIGPGRAFYTTGDIIGDIRQAHCNISRAQWNNTLKHIVEKLGKQFGNNKTIIFKPSSGGDPEIVMHSFNCRGEFFYCNTSKLFNSTWTRNNGTWTRNDTERSNSTEEHITLPCRIKQIINMWQRVGQAMYAPPIAGNITCNSSITGLLLTRDGGNDTSGTEIFRPGGGNIKDNWRSELYKYKVVQIEPLGVAPTRAKRRVVEREKRAVGIGAMIFGFLGAAGSTMGAASMALTVQARQLLSGIVQQQSNLLMAIEAQQHLLKLTVWGIKQLRARVLAVERYLKDQQLLGIWGCSGKHICTTNVPWNSSWSNKSLDEIWNNMTWIEWEREINNYTGLIYNLLEKSQNQQEKNEQDLLALDKWASLWSWFDISNWLWYIKIFIIIVGGLIGLRIVFAVLSLVNRVRQGYSPLSLQTLLPTPRGPDRPEGTEEEGGEQGRDRSIRLVSGFLALAWDDLRSLCRFSYHRLRDFILIVARTVELLGRSSLKGLRLGWEGLKYLGNLLLYWGQELKISAISLLDTTAIAVAGWTDRVIEIGQRLCRAIRNIPRRIRQGAERALQ

SEQ ID NO: 124 - protein, 858 aa, Human immunodeficiency virus 1
MRVKETQMNWPNLWKWGTLILGLVIICSASDNLWVTVYYGVPVWRDADTTLFCASDAKAHETEVHNVWATHACVPTDPNPQEIHLENVTEEFNMWKNNMVEQMHTDIISLWDQSLKPCVRLTPLCVTLNCTDELKNATFRSNTTTNSSWEKMERGEIKNCSFNITTSIRDKVQKEYALFYKLDIVPLNSNSSEYRLINCNTSVIKQACPKISFDPIPIHYCAPAGFAILKCKDKKFNGTGPCQNVSTVQCTHRIKPVVSTQFLLNGSLAEEDIIIRSENITNNAKTIIVQLNESVVINCTRPNNNTRRSIPIGPGRVFYTTEDIIGDIRQAHCNLSRAKWNDTLKQIVIKLREQFGNKTIVFNQSSGGDLEIVMHSFNCGGEFFYCNSTQLFNSTWFNSTWSTEGSNNTEGSDTITLPCRIKQIVNMWQGVGKAMYAPPIRGQIRCSSNITGILLTRDGGTNGTNETETFRPGGGNMKDNWRSELYRYKVVKIEPLGIAPTKAKRRVVEREKRAIGLGAMFLGFLGTAGSTMGAASLTLTVQARQLMSGIVQQQNNLLRAIEAQQHMLKLTVWGIKQLQARVLALERYLKDQQLLGLWGCSGKLICTTTVPWNSSWSNKSQTDIWDNMTWMQWDREISNYTNTIYRLLEDSQNQQEKNEKDLLALDSWKNLWNWFDITKWLWYIKIFIMIVGGLIGLKIVFAVLSIINRVRQGYSPLSFQTLIPNPRGPDRPGGIEEEGGEQDRDRSIRLVNGFLALIWVDLRSLFLFSYHRLRDLLLIVTRIVELLGRRGWEALKYWWNLLQYWSQELKNSAINLLDTIAIAVAEGTDRIIEVIQRICRAIRNIPTRIRQGLERALL

SEQ ID NO: 125 - protein, 860 aa, Human immunodeficiency virus 1
MRVKGIRKNYQHLWKWGTMLLGMLMICSATEKLWVTVYYGVPVWKEATTTLFCASDAKAYDTEVHNVWATYACVPTDPNPQELVLENVTENFDMWKNNMVEQMHEDIINLWDQSLKPCVKLTPICVTLNCTDYVKNITNNATSTNSSWGKPMEKGEIKNCSFNMTTELRDKKQKVYSLFYKLDVVQMDEDNTSYRLISCNTSVITQACPKISFEPIPIHYCTPAGYAILKCNDKNFNGTGPCKNVSSVQCTHGIKPVISTQLLLNGSLAEEEIIIRSENLTNNVKTIIVHLNKSVEINCTRPSNNTRTSIRIGPGQAFYATGDIIGDIRKAHCNISRANWNNTLRQIVEKLGEQFGNNKTIVFNHSSGGDPEITTHSFNCGGEFFYCNTTKLFNSTWTWNNSTWNNTKRSNDTEEIITLPCRIKQIINMWQEVGKAMYAPPIQGVIRCESNITGLILTRDGGNNNSTNETFRPGGGDMRDNWRSELYKYKVVRIEPLGVAPTEAKRRVVQREKRAVGTIGAMFLGFLGAAGSTMGAASVTLTVQARLLLSGIVQQQNNLLKAIEAQQHLLRLTVWGIKQLQARVLAIERYLQDQQLLGIWGCSGKLICTTNVPWNTSWSNRSLNEIWNNMTWMEWEKEIDNYTNLIYNLLEESQIQQEKNEQELLALDKWANLWNWFDISNWLWYIRIFIIIVGGLVGLRIVFAVLSIVNKVRQGYSPLSFQTHLPAQRGPDRPEGIEEGGGEQDRDRSVRLVDGFLAIIWVDLRSLCLFSYHHLRDLLLIVARIVELLGRRGWEVLKYWWNLLKYWSQELKNSAVSLLNATAIAVAEGTDRIIELIQRICRAICNIPRRIRQGFERALL

SEQ ID NO: 126 - protein, 866 aa, Human immunodeficiency virus 1
MRVKETRKNYQHLWRWGIMLLGMLMICSAAEQLWVTVYYGVPVWKEAKTTLFCASNAKAYDTEAHNVWATHACIPTDPNPQEIVLENVTESFNMWKNDMVDQMHEDVISLWDQSLKPCVQLTPLCVTLNCTNVNVTNLKNETNTKSSSGGEKMEEGEMKNCSFNVTTELRDKKKKEYALFYRLDIVPLNEGNNSNSSYYRLINCNTSTITQACPKVSFEPIPIHFCAPAGFAILKCNDKKFNGTGPCKNVSTVQCTHGIKPVVSTQLLLNGSLAEKEIIIRSENLTNNAKIIIVQLNESVEINCTRPGNNTRKSIRIGPGQTFYATGDIIGNIRQAHCNISRTQWNNTLKQIAIKLREQFGNKTIIFNQSSGGDPEIVTHSFNCGGEFFYCKSTKLFNSTWNSTSLFNSTNGTITLQCRIKQIINRWQEVGKAMYAPPIEGNITCKSNITGLLLVRDGGINVTNNTGTEVFRPGGGDMKDNWRNELYKYKVVEIKPLGVAPTRARRRVVEREKRAVGLGAVFLGFLGAAGSTMGAAAVTLTVQARQLLFGIVQQQSNLLRAIEAQQRMLQLTVWGIKQLQTRVLAIERYLKDQQLLGMWGCSGKLICTTAVPWNSSWSNKTYNDIWDNMTWLQWDKEISNYTDTIYRLLEESQNQQERNEKDLLELDKWASLWNWFNITNWLWYIKIFIMIIGGLIGLRIIFAVLSIVNRVRQGYSPLSFQTLTPNPRGPDRLGRIEEEGGEQDKDRSIRLVNGFSALIWDDLRNLCLFSYHQLRDFILVTARAVELLGRSSLRGLQRGWEALKYLGSLVQYWGLELKKSAISLLDTIAIAVANWTDRVIEVVQRAYRAILHIPTRIRQGFEAALQ

SEQ ID NO: 127 - protein, 1003 aa, Human immunodeficiency virus 1
FFRENLAFPQGKAREFSSEQTRANSPTRRELQVWGRDNNSLSEAGADRQGTVSFSFPQITLWQRPLVTIKIGGQLKEALLDTGADDTVLEEMNLPGRWKPKMIGGIGGFIKVRQYDQIPIEICGHKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIVLPEKDSWTVNDIQKLVGKLNWASQIYAGIKVKQLCKLLRGTKALTEVIPLTEEAELELAENREILKEPVHGVYYDPSKDLIAEIQKQGQGQWTYQIYQEPFKNLKTGKYARMRGAHTNDVKQLTEAVQKIATESIVIWGKTPKFKLPIQKETWETWWTEYWQATWIPEWEFVNTPPLVKLWYQLEKEPIVGAETFYVDGAANRETKLGKAGYVTDRGRQKVVSLTDTTNQKTELQAIHLALQDSGLEVNIVTDSQYALGIIQAQPDKSESELVSQIIEQLIKKEKVYLAWVPAHKGIGGNEQVDKLVSAGIRKVLFLDGIDKAQEEHEKYHSNWRAMASDFNLPPVVAKEIVASCDKCQLKGEAMHGQVDCSPGIWQLDCTHLEGKIILVAVHVASGYIEAEVIPAETGQETAYFLLKLAGRWPVKTIHTDNGSNFTSTTVKAACWWAGIKQEFGIPYNPQSQGVVESMNKELKKIIGQVRDQAEHLKTAVQMAVFIHNFKRKGGIGGYSAGERIVDIIATDIQTKELQKQITKIQNFRVYYRDSRDPLWKGPAKLLWKGEGAVVIQDNSDIKVVPRRKAKIIRDYGKQMAGDDCVASRQDED

SEQ ID NO: 128 - protein, 1003 aa, Human immunodeficiency virus 1
FFRENLAFPQGKAREFPSEQTRANSPTSRELQVWGGDNNSLSEAGDDRQGTVSFSFPQITLWQRPIVTIKIGGQQKEALLDTGADDTVLEEMNLPGRWKPKIIGGIGGFIKVKQYDQILIEICGHKAIGTVLVGPTPANIIGRNLLTQIGCTLNFPISPIETVPVRLKPGMDGPKVKQWPLTEEKIKALIEICTELENEGKISKIGPENPYNTPVFAIKKKDGTKWRKLVDFRELNKRTQDFWEVQLGIPHPAGLKKKKSVTVLDVGDAYFSVPLDKEFRKYTAFTIPSINNETPGIRYQYNVLPQGWKGSPSIFQSSMTKILEPFRKQNPEIVIYQYMDDLYVGSDLEIEQHRTKIEELRQHLLKWGFYTPDKKHQKEPPFLWMGYELHPDKWTVQPIVLPEKDSWTVNDIQKLVGKLNWASQIYAGIKVKQLCRLLRGTKALTEVVPLTEEAELELAENREILKEPVHGVYYDPSKDLVAEIQKQGLGQWTYQIYQEPYKNLKTGKYAKMRGAHTNDVKQLTEAVQKIATESIVIWGKTPKFRLPIQKETWEAWWMEYWQATWIPEWEFVNTPPLVKLWYQLEKEPIVGAETFYVDGAANRDTKLGKAGYVTDRGRQKVVSLTDTTNQKTELQAIHLALQDSGLEVNIVTDSQYAIGIIQAQPDRSESELVSQIIEQLIKKEKVYLAWVPAHKGIGGNEQVDKLVSSGIRKVLFLDGIDKAQEDHEKYHSNWKAMASDFNLPPVVAKEIVACCDKCQLKGEAMHGQVDCSPGIWQLDCTHLEGKVILVAVHVASGYIEAEVIPAETGQETAYFILKLAGRWPVTTIHTDNGSNFTSTAVKAACWWAGIKQEFGIPYNPQSQGVVESINKELKKIIKQVRDQAEHLKTAVQMAVFVHNFKRKGGIGGYSAGERMIDIIATDIQTTELQKQITKLQNFRVYFRDSRDPLWKGPAKLLWKGEGAVVIQDNSEIKVVPRRKAKIIRDYGKQMAGDDCVASRQDED

SEQ ID NO: 129 - protein, 1003 aa, Human immunodeficiency virus 1
FFREDLAFLQGKAREFSSEQTRANSPTRGELQVWGRDNNSLSEAGADRQGTVSLSFPQITLWQRPLVTVKIGGQLKEALLDTGADDTVLEEMSLPGRWKPKMIGGIGGFIKVRQYDQILVEICGHKAIGTVLIGPTPVNIIGRDLLTQIGCTLNFPISPIDTVPVKLKPGMDGPKVKQWPLTEEKIKALVEICTEMEKEGKISKIGPENPYNTPIFAIKKKDSTKWRKLVDFRELNRRTQDFWEVQLGIPHPAGLKQKKSVTVLDVGDAYFSVPLDEDFRKYTAFTIPSTNNETPGIRYQYNVLPQGWKGSPAIFQSSMTRILEPFRKQNPDLVIYQYMDDLYVGSDLEIGQHRTKIEELREHLLKWGFTTPDKKHQKEPPFLWMGYELHPDKWTVQPIMLPEKDSWTVNDIQKLVGKLNWASQIYPGIKVKQLCKLLRGAKALTEVIPLTKEAELELAENREILKEPVHGAYYDPSKDLIAEIQKQGQGQWTYQIYQDPFKNLKTGKYARMRGAHTNDVRQLTEAVQKITTESIVIWGKIPKFKLPIQKETWETWWTEYWQATWIPEWEFVNTPPLVKLWYQLEKEPIIGAETFYVDGAANRETKLGKAGYVTNKGRQKVVSITDTTNQKTELQAILLALQDSGLEVNIVTDSQYAIGIIQAQPDKSESELVSQIIEELIKKEKVYLTWVPAHKGIGGNEQIDKLVSAGIRKVLFLDGIDQAQEEHEKYHSNWRAMASDFNIPPVVAKEIVASCDKCQLKGEAIHGQVDCSPGIWQLDCTHLEGKIILVAVHVASGYIEAEIIPTETGQETAYFLLKLAGRWPVKTVHTDNGSNFTSTTVKAACWWAGVKQEFGIPYNPQSQGVVESMNNELKKIIGQIRDQAEHLKTAVQMAVFIHNFKRKGGIGGYSAGERIVDIIATDIQTKELQKQITKIQNFRVYYRDNRDPLWKGPAKLLWKGEGAVVIQENSDIKVVPRRKVKIIRDYGKQMAGDDCVASGQDED

SEQ ID NO: 130 - protein, 1003 aa, Human immunodeficiency virus 1
FFREDLAFPQGEAREFSSEQTRANSPTRRELQVWGRDSNSLSEAGADRQGTVSFNFPQITLWQRPLVTIKIGGQLKEALLDTGADDTVLEDMNLPGKWKPKMIGGIGGFIKVRQYDQIPIEICGHKAVGTVLVGPTPVNIIGRNLLTQLGCTLNFPISPIETVPVKLKPGMDGPKVKQWPLTEEKIKALVEICTELEKEGKISKIGPENPYNTPVFAIKKKDSTKWRKVVDFRELNKKTQDFWEVQLGIPHPSGLKKKKSVTVLDVGDAYFSVPLDKDFRKYTAFTIPSVNNETPGVRYQYNVLPQGWKGSPAIFQCSMTKILEPFRKQNPDIVIYQYMDDLYVGSDLEIGQHRAKIEELRQHLLRWGFTTPDKKHQNEPPFLWMGYELHPDKWTVQPIELPEKDSWTVNDIQKLVGKLNWASQIYPGIKVRQLCKLLRGTKALTEVIPLTEEAELELAENREILREPVHGVYYDPTKDLIAEIQKQEQGQWTYQIYQEPFKNLKTGKYARTRGAHTNDVKQLTEAVQKVATESIVIWGKTPKFKLPIQKETWEAWWTEYWQATWIPEWEFVNTPPLVKLWYQLEKEPIEGAETFYVDGASNRETKLGKAGYVTNRGRQKVVPLTDTTNQKTELQAIYLALQDSGSEVNIVTDSQYALGIIQAQPDKSESELVNQIIEQLIKKEKIYLAWVPAHKGIGGNEQVDKLVSAGIRKILFLDGIDKAQEEHEKYHNNWRAMASDFNLPPIVAKEIVASCDKCQLKGEAIHGQVDCSPGIWQLDCTHLEGKVILVAVHVASGYIEAEVIPAETGQETAYFILKLAGRWPVKTIHTDNGSNFTSATVKAACWWAGIKQEFGIPYNPQSQGVVESMNKELKKIIGQVRDQAEHLKTAVQMAVFIHNFKRKGGIGEYSAGERIIDIIATDIQTRELQKQITKIQNFRVYYRDSRDPLWKGPAKLLWKGEGAVVIQDNSDIKVVPRRKAKIIRDYGKQMAGDDCVAGRQDED

SEQ ID NO: 131 - protein, 1003 aa, Human immunodeficiency virus 1
FFRENLAFPQGEAREFSSEQNRANSPTRRELQVWGGDNNSLSEAGADRQGTVSLSFPQITLWQRPLVTIRIGGQLKEALLDTGADDTVLEEMSLPGRWKPKMIGGIGGFIKVRQYDQILIEICGHKAIGTVLIGPTPVNIIGRNLLTQLGCTLNFPISPIDTVPVKLKPGMDGPKVKQWPLTEEKIKALVEICTEMEKEGKISKIGPENPYNTPIFAIKKKDSTKWRKLVDFRELNRRTQDFWEVQLGIPHPSGLKKKKSVTVLDVGDAYFSVPLDKDFRKYTAFTIPSINNETPGVRYQYNVLPQGWKGSPAIFQSSMTKILEPFRKQNPDMVIYQYMDDLYVGSDLEIGQHRTKIEELRQHLLRWGLTTPDKKHQKEPPFLWMGYELHPDKWTVQPIKLPEKDSWTVNDIQKLVGKLNWASQIYAGIKVRQLCKLLRGAKALTEVIPLTAEAELELAENREILREPVHGVYYDPSKDLIAEIQKQGQGQWTYQIYQDPFKNLKTGKYAKMRGAHTNDVKQLTEAVQKVATESIVIWGKTPKFRLPIQKETWEAWWTEYWQATWIPEWEFVNTPPLVKLWYQLEKEPIEGAETFYVDGAANRDTKLGKAGYVTDRGRQKVVSLTDTTNQKTELQAIHLALQDSGLEVNIVTDSQYALGIIQAQPDKSESELVSQIIEELIKKEKVYLAWVPAHKGIGGNEQIDKLVSAGIRRVLFLDGIDQAQEEHEKYHSNWRAMASDFNLPPIVAKEIVASCDKCQLKGEAIHGQVDCSPGIWQLDCTHLEGKIILVAVHVASGYIEAEVIPAETGQETAYFLLKLAGRWPVKTIHTDNGSNFTSTTVKAACWWAGIKQEFGIPYNPQSQGVVESMNKELKKIIEQVRDQAEHLKTAVQMAVFIHNFKRKGGIGEYSAGERIIDIIATDIQTRELQKQITKIQNFRVYYRDNRDPLWKGPAKLLWKGEGAVVIQDNSDIKVVPRRKAKIIRDYGKQMAGDDCVAGRQDED

SEQ ID NO: 132 - protein, 1003 aa, Human immunodeficiency virus 1
FFRENLAFPQGKAREFPSEQTRANSPTSRELQVWGRDNNSLSEAGDDRQGTVSFSFPQITLWQRPLVTVKIGGQLKEALLDTGADDTVLEEMNLPGRWKPKMIGGIGGFIKVRQYDQIPIEICGHKAVGTVLVGPTPVNIIGRDLLTQIGCTLNFPISPIETVPVKLKPGMDGPKVKQWPLTEEKIKALIEICTELENEGKISKIGPENPYNTPVFAIKKKDGTKWRKLVDFRELNKRTQDFWEVQLGIPHPAGLKQKKSVTVLDVGDAYFSVPLDKEFRKYTAFTIPSTNNETPGIRYQYNVLPQGWKGSPAIFQCSMTKILEPFRKQNPDLVIYQYMDDLYVGSDLEIEQHRTKIEELREHLLKWGFTTPDKKHQNEPPFLWMGYELHPDKWTVQPIMLPEKDSWTVNDIQKLVGKLNWASQIYAGIKVKQLCKLLRGTKALTEVVPLTEEAELELAENREILKVPVHGVYYDPSKDLVAEIQKQGLGQWTYQIYQEPFKNLKTGKYARTRGAHTNDVRQLTEAVQKIATESIVIWGKTPKFKLPIQKETWEAWWMEYWQATWIPEWEFVNTPPLVKLWYQLEKEPIVGAETFYVDGAANRETKLGKAGYVTDKGRQKVVPLTDTTNQKTELQAINLALQDSGSEVNIVTDSQYAIGIIQAQPDRSESELVSQIIEQLINKEKVYLAWVPAHKGIGGNEQVDKLVSSGIRKVLFLDGIDKAQEDHEKYHSNWRAMAGDFNLPPVVAKEIVACCDKCQLKGEAMHGQVDCSPGIWQLDCTHLEGKVILVAVHVASGYIEAEVIPAETGQETAYFILKLAGRWPVKTVHTDNGSNFISTTVKAACWWAGVKQEFGIPYNPQSQGVVESMNNELKKIIGQVRDQAEHLKTAVQMAVFVHNFKRKGGIGGYTAGERIVDIIASDIQTKELQKQITKIQNFRVYYRDSRDPIWKGPAKLLWKGEGAVVIQDNSEIKVVPRRKAKIIRDYGKQMAGDDCVASRQNED

SEQ ID NO: 133 - protein, 1003 aa, Human immunodeficiency virus 1
FFREDLAFLQGKAREFSSEQTRANSPTRRELQVWGRDNNSPSEAGADRQGTVSFNFPQITLWQRPIVTIKIGGQLKEALLDTGADDTVLEDMNLPGKWKPKMIGGIGGFIKVRQYDQILVEICGHKAIGTVLVGPTPANIIGRNLLTQIGCTLNFPISPIETVPVKLKSGMDGPKVKQWPLTEEKIKALIEICTEMEKEGKISKIGPENPYNTPVFAIKKKDSTKWRKLVDFRELNKRTQDFWEVQLGIPHPSGLKKKKSVTVLDVGDAYFSVPLDEDFRKYTAFTIPSVNNETPGIRYQYNVLPQGWKGSPAIFQSSMTRILEPFRKQNPDIVIYQYMDDLYVGSDLEIGQHRAKIEELRQHLLRWGFTTPDKKHQKEPPFLWMGYELHPDKWTVQPIELPEKDSWTVNDIQKLVGKLNWASQIYPGIKVRQLCKLLRGTKALTEVIPLTEEAELELAENREILKEPVHGVYYDPSKELIAEIQKQEQGQWTYQIYQEPFKNLKTGKYARMRGTHTNDVKQLTEAVQKITTESIVIWGRTPKFKLPIQKETWESWWTEYWQATWIPEWEFVNTPPLVKLWYQLEREPIAGAETFYVDGASNRETKLGKAGYVTNRGRQKVVSLPDTTNQKTELQAIYLALQDSGLEVNIVTDSQYAIGIIQAQPDKSESELVNQIIEQLIKKEKIYLAWVPAHKGIGGNEQVDKLVSNGIRKILFLDGIDKAQDEHEKYHSNWKAMASDFNLPPVVAKEIVACCDKCQLKGEAMHGQVDCSPGIWQLDCTHLEGKIILVAVHVASGYIEAEVIPAETGQETAYFLLKLAGRWPVKIIHTDNGSNFTSTAVKAACWWAGIKQEFGIPYNPQSQGVVESINKELKKIIKQVRDQAEHLKTAVQMAVFIHNFKRKGGIGGYSAGERMIDIIATDIQTTELQKQITKLQNFRVYFRDSRDPLWKGPAKLLWKGEGAVVIQDNNDIKVVPRRKVKIIRDYGKQMAGDDCVASGQDED

SEQ ID NO: 134 - protein, 1003 aa, Human immunodeficiency virus 1
FFREDLAFPQGKARELSSEQTRANSPTRGELQVWGRDSNSLSEAGADRPGTVSFSFPQITLWQRPLVTIKIGGQQKEALLDTGADDTVLEEINLPGRWKPKIIGGIGGFIKVKQYDQIPIEICGHKVIGTVLVGPTPANIIGRNLLTQLGCTLNFPISPIETVPVRLKPGMDGPKVKQWPLTEEKIKALVEICTELEKEGKISKIGPENPYNTPVFAIKKKDSTKWRKVVDFRELNKKTQDFWEVQLGIPHPAGLKKKKSVTVLDVGDAYFSVPLDENFRKYTAFTIPSINNETPGIRYQYNVLPQGWKGSPSIFQSSMTKILEPFRKQNPEIVIYQYMDDLYVGSDLELGQHRTKIEELRQHLLKWGFYTPDKKHQKEPPFLWMGYELHPDKWTVQPIVLPEKDSWTVNDIQKLVGKLNWASQIYPGIKVKQLCRLLRGAKALTEVIPLTKEAELELAENREILKEPVHGAYYDPTKDLIAEIQKQGEGQWTYQIYQEPYKNLKTGKYARMRGAHTNDVKQLTETVQKITTESIVIWGKIPKFKLPIQKETWETWWTEYWQATWIPEWEFVNTPPLVKLWYQLEKEPIIGAETFYVDGAASRETKLGKAGYVTNKGRQKVVSITDTTNQKTELQAILLALQDSGLEVNIVTDSQYAIGIIQAQPDKSESEIVSQIIEQLIKKEKVYLTWVPAHKGIGGNEQVDKLVSAGIRKVLFLDGIDKAQEEHEKYHNNWRAMASDFNIPPVVAKEIVASCDKCQLKGEAMHGQVDCSPGIWQLDCTHLEGKVILVAVHVASGYIEAEIIPTETGQETAYFILKLAGRWPVTTIHTDNGSNFTSATVKAACWWAGVKQEFGIPYNPQSQGVIESMNKELKKIIGQIRDQAEHLKTAVQMAVFIHNFKRKGGIGGYSAGERIVDIIATDIQTKELQNQITKIQNFRVYYRDSRDPLWKGPAKLLWKGEGAVVIQENSDIKVVPRRKVKIIRDYGKQMAGDDCVASRQDED

SEQ ID NO: 135 - protein, 1003 aa, Human immunodeficiency virus 1
FFREDLAFPQGEAREFCSEQTRANSPATRELQVWGRDNTSLSEAGADRPGTVSFSFPQITLWQRPIVTVKIEGQLKEALLDTGADDTVLEEMNLPGKWKPKMIGGIGGFIKVRQYDQVSIEICGHKAIGTVLVGPTPANIIGRNLLTQIGCTLNFPISPIETVPVKLKPGMDGPKVKQWPLTEEKIKALVEICTELEKEGKISKIGPENPYNTPVFAIKKKDSTKWRKVVDFRELNKRTQDFWEVQLGIPHPSGLKKKKSVTVLDVGDAYFSVPLDENFRKYTAFTIPSINNETPGIRYQYNVLPQGWKGSPAIFQSSMTKILEPFRKQNPDIIIYQYMDDLYVGSDLEIGQHRAKIEELRQHLLKWGFTTPDKKHQKEPPFLWMGYELHPDKWTVQPIELPEKDSWTVNDIQKLVGKLNWASQIYAGIKVKELCKLLRGTKALTEVVPLTEEAELELAENREILKEPVHGVYYDPSKDLIAELQKQGQGQWTYQIYQEPYKNLKTGKYARTRGAHTNDVRQLTEAVQKIATEGIVIWGKTPKFKLPIQKETWEAWWTEYWQATWIPEWEFVNTPPLVKLWYQLEKEPILGAETFYVDGASNRETKLGKAGYVTDRGRQKVVSLTDTTNQKTELQAINLALQDSGLEVNIVTDSQYALGIIQAQPDRSESELVSQIIEQLINKEKVYLAWVPAHKGIGGNEQVDKLVSTGIRRVLFLDGIDKAQEEHEKYHSNWRAMASDFNLPPIVAKEIVASCDKCQLKGEAIHGQVDCSPGIWQLDCTHLEGKVILVAVHVASGYIEAEVIPAETGQETAYFILKLAGRWPVKTIHTDNGSNFTSTTVKAACWWAGIKQEFGIPYNPQSQGVVESMNKELKKIIEQVRDQAEHLKTAVQMAVFVHNFKRKGGIGEYSAGERIVDIIATDIQTKELQKHITKIQNFRVYYRDSRDPLWKGPAKLLWKGEGAVVIQDNSEIKVVPRRKAKIIRDYGKQMAGDDCVASRQDED

SEQ ID NO: 136 - protein, 1006 aa, Human immunodeficiency virus 1
FFREDLAFPQGKARELSSEQTRANSPTSPTRGELQVWGRDSNSLSEAGADRQGPVSFSFPQITLWQRPIVTIKIGGQLKEALLDTGADDTVLEDMNLPGRWKPKMIGGIGGFIKVKQYDEILVEICGHKAIGTVLIGPTPVNIIGRNLLTQLGCTLNFPISPIETVPVKLKSGMDGPKVKQWPLTEEKIKALVEICTELEKEGKISKIGPENPYNTPIFAIKKKDSTKWRKLVDFRELNKRTQDFWEVQLGIPHPAGLKKKKSVTVLDVGDAYFSVPLDKDFRKYTAFTIPSVNNETPGIRYQYNVLPQGWKGSPAIFQCSMTKILEPFRKQNPDMVIYQYMDDLYVGSDLEIGQHRIKIEELREHLLKWGFTTPDKKHQNEPPFLWMGYELHPDKWTVQPIVLPEKDSWTVNDIQKLVGKLNWASQIYPGIKVRQLCKLLRGTKALTEVIPLTEEAELELAENREILREPVHGVYYDPTKDLIAEIQKQGQGQWTYQIYQEPFKNLKTGKYARMRGAHTNDVKQLTEAVQKITTESIVIWGKIPKFRLPIQKETWEAWWIEYWQATWIPEWEFVNTPPLVKLWYQLEREPIAGAETFYVDGAANRETKLGKAGYVTNRGRQKVVSITDTTNQKTELQAILLALQDSGLEVNIVTDSQYALGIIQAQPDKSESELVNQIIEQLIKKEKIYLAWVPAHKGIGGNEQIDKLVSAGIRKVLFLDGIDKAQDEHEKYHSNWRAMAGDFNLPPVVAKEIVACCDKCQLKGEAMHGQVDCSPGIWQLDCTHLEGKIILVAVHVASGYIEAEVIPAETGQETAYFLLKLAGRWPVTTIHTDNGSNFTSATVKAACWWAGVKQEFGIPYNPQSQGVIESMNKELKKIIGQVRDQAEHLKTAVQMAVFIHNFKRKGGIGEYSAGERIIDIIATDIQTKELQKQITKIQNFRVYYRDSRDPIWKGPAKLLWKGEGAVVIQDNSEIKVVPRRKAKIIRDYGKQMAGDDCVAGRQDED

SEQ ID NO: 137 - protein, 1003 aa, Human immunodeficiency virus 1
FFRENLAFPQGEAREFSSEQTRANSPTRGELQVWGRDSNSLSEAGDDRQGTVSFSFPQITLWQRPLVTIKIGGQQKEALLDTGADDTVLEEMNLPGRWKPKIIGGIGGFIKVTQYDQIPIEICGHKAVGTVLVGPTPVNIIGRDLLTQIGCTLNFPISPIETVPVKLKSGMDGPKVKQWPLTEEKIKALIEICTEMEKEGKISKIGPENPYNTPVFAIKKKDGTKWRKLVDFRELNKKTQDFWEVQLGIPHPAGLKQKKSVTVLDVGDAYFSVPLDREFRKYTAFTIPSLNNETPGIRYQYNVLPQGWKGSPSIFQSSMTKILEPFRKQNPDLVIYQYMDDLYVGSDLELGQHRTKIEELRQHLLKWGFYTPDKKHQKEPPFLWMGYELHPDKWTVQPIKLPEKDSWTVNDIQKLVGKLNWASQIYPGIKVKQLCRLLRGAKALTEVVPLTKEAELELAENREILKEPVHGAYYDPTKDLIAEVQKQELGQWTYQIYQEPFKNLKTGKYARMKGAHTNDVKQLTETVQKITTESIVIWGKTPKFRLPIQKETWESWWTEYWQATWIPEWEFVNTPPLVKLWYQLEKEPITGAETFYVDGAANRETKIGKAGYVTDKGRQKVVSLPDTTNQKTELQAIHLALQDSGSEVNIVTDSQYAIGIIQAQPDRSESEVVNQIIEQLIKKEKVYLAWVPAHKGIGGNEQVDKLVSNGIRKILFLDGIDKAQEEHERYHSNWKAMASDFNLPPVVAKEIVACCDKCQLKGEAIHGQVDCSPGIWQLDCTHLEGKVILVAVHVASGYIEAEVIPAETGQETAYFILKLAGRWPVKIIHTDNGSNFTSTAVKAACWWAGIKQEFGIPYNPQSQGVVESINKELKKIIKQVRDQAEHLKTAVQMAVFIHNFKRKGGIGGYSAGERIIDIIASDIQTKELQNQITKIQNFRVYYRDSRDPVWKGPAKLLWKGEGAVVIQDNSDIKVVPRRKAKIIRDYGKQMAGDDCVASRQNED

SEQ ID NO: 138 - protein, 1003 aa, Human immunodeficiency virus 1
FFRENLAFPQRKAREFSSEQTRANSPTRRELQVWGGDNNSLSEAGADRQGTVSLSFPQITLWQRPLVTIKVGGQLKEALLDTGADDTVLEEINLPGRWKPKMIGGIGGFIKVRQYDQILVEICGHKAIGTVLVGPTPVNIIGRNLLTQIGCTLNFPISPIETVPVKLKPGMDGPKVKQWPLTEEKIKALVEICTEMEKEGKISKIGPENPYNTPIFAIKKKDSTKWRKLVDFRELNRRTQDFWEVQLGIPHPAGLKKKKSVTVLDVGDAYFSVPLDEDFRKYTAFTIPSINNETPGVRYQYNVLPQGWKGSPAIFQASMTKILEPFRKQNPDIVIYQYMDDLYVGSDLEIGQHRIKIEELRQHLLRWGLTTPDKKHQKEPPFLWMGYELHPDKWTVQPIMLPEKDSWTVNDIQKLVGKLNWASQIYAGIKVRQLCKLLRGAKALTEVIPLTAEAELELAENREILKVPVHGVYYDPSKELIAEIQKQEQGQWTYQIYQDPFKNLKTGKYARMRGTHTNDVRQLTEAVQKITTESIVIWGKIPKFKLPIQKETWETWWTEYWQATWIPEWEFVNTPPLVKLWYQLEKEPIIGAETFYVDGAASRETKLGKAGYVTDRGRQKVISLTDTTNQKTELQAIHLALQDSGVEVNIVTDSQYALGIIQAQPDKSESEIVSQIIEQLIKKEKVYLTWVPAHKGIGGNEQVDKLVSTGIRKVLFLDGIDQAQEEHEKYHSNWRTMASDFNLPPIVAKEIVASCDKCQLKGEAMHGQVDCSPGIWQLDCTHLEGKVILVAVHVASGYIEAEVIPAETGQETAYFLLKLAGRWPVKTIHTDNGPNFISTTVKAACWWAGIKQEFGIPYNPQSQGVVESMNNELKKIIGQVREQAEHLKTAVQMAVFIHNFKRKGGIGGYSAGERMIDIIATDIQTTELQKQITKLQNFRVYFRDSRDPLWKGPAKLLWKGEGAVVIQENSDIKVVPRRKAKIIRDYGKQMAGDDCVAGRQDED

SEQ ID NO: 139 - protein, 1003 aa, Human immunodeficiency virus 1
FFRENLAFPQGKAREFPSEQTRANSPTSRELQVWGRDNNSLSEAGANRQGTVSFSFPQITLWQRPLVTVKIGGQLKEALLDTGADDTVLEDMDLPGRWKPKMIGGIGGFIKVRQYDQIPIEICGHKVIGTVLVGPTPANIIGRNLLTQIGCTLNFPISPIETVPVRLKPGMDGPKVKQWPLTEEKIKALVEICTELEKEGKISKIGPENPYNTPVFAIKKKDSTKWRKLVDFRELNKKTQDFWEVQLGIPHPSGLKKKKSVTVLDVGDAYFSVPLDKEFRKYTAFTIPSTNNETPGIRYQYNVLPQGWKGSPAIFQASMTKILEPFRKQNPEIVIYQYMDDLYVGSDLEIEQHRTKIEELRQHLLRWGFTTPDKKHQKEPPFLWMGYELHPDKWTVQPIVLPDKDSWTVNDIQKLVGKLNWASQIYPGIKIRQLCKLLRGAKALTEVIPLTKEAELELAENREILKEPVHGVYYDPSKDLIAEIQKQGEGQWTYQIYQEPFKNLKTGKYAKMRGAHTNDVKQLTEAVQKVATESIVIWGKTPKFKLPIQKETWEAWWMEYWQATWIPEWEFVNTPPLVKLWYQLEKEPIEGAETFYVDGAANRDTKLGKAGYVTNKGRQKVVTLTDTTNQKTELQAIHLALQDSGLEVNIVTDSQYALGIIQAQPDKSESEIVNQIIEQLIKKEKVYLAWVPAHKGIGGNEQVDKLVSSGIRKVLFLDGIDKAQEDHEKYHSNWRAMANDFNLPPVVAKEIVACCDKCQLKGEAMHGQVDCSPGIWQLDCTHLEGKVILVAVHVASGYIEAEVIPAETGQETAYFILKLAGRWPVKTVHTDNGSNFTSNTVKAACWWAGIKQEFGIPYNPQSQGVVESMNKQLKQIIGQVRDQAEHLKTAVQMAVFIHNFKRKGGIGGYTAGERIVDIIATDIQTRELQKQITKIQNFRVYYRDSREPLWKGPAKLLWKGEGAVVIQDNSDIKVVPRRKAKIIRDYGKQMAGDDCVASGQDED

SEQ ID NO: 140 - protein, 1003 aa, Human immunodeficiency virus 1
FFREDLAFLQGKAREFSSEQTRAISPTRRELQVWGRDNNSPSEAGADRQGTVSFNFPQITLWQRPLVTIRIGGQLKEALLDTGADDTVLEEMSLPGRWKPKMIGGIGGFIKVRQYDQILIEICGHKAVGTVLIGPTPVNIIGRNLLTQIGCTLNFPISPIDTVPVKLKPGMDGPKVKQWPLTEEKIKALIEICTELENEGKISKIGPENPYNTPIFAIKKKDSTKWRKLVDFRELNKRTQDFWEVQLGIPHPSGLKKKKSVTVLDVGDAYFSIPLDEDFRKYTAFTIPSINNETPGTRYQYNVLPQGWKGSPAIFQSSMTRILEPFRKQNPDIVIYQYVDDLYVGSDLEIGQHRTKIEELREHLLRWGFTTPDKKHQKEPPFLWMGYELHPDKWTVQPITLPEKDSWTVNDIQKLVGKLNWASQIYAGIKVKQLCKLLRGTKSLTEVVPLTAEAELELAENREILKEPVHGAYYDPSKDLVAEIQKQGLGQWTYQIYQEPFKNLKTGKYAKMRGTHTNDVKQLTEAVQKIATESIVIWGRTPKFKLPIQKETWDAWWTEYWQATWIPEWEFVNTPPLVKLWYQLEKEPIVGAETFYVDGAANRETRLGKAGYVTDRGRQKVVPLTDTTNQKTELQAIYLALQDSGLEVNIVTDSQYALGIIQAQPDKSESELVSQIIEELIKKEKVYLAWVPAHKGIGGNEQVDKLVSAGIRRVLFLDGIDKAQEEHEKYHNNWRAMASDFNIPPVVAKEIVASCDKCQLKGEAIHGQVDCSPGIWQLDCTHLEGKIILVAVHVASGYIEAEIIPTETGQETAYFLLKLAGRWPVKTIHTDNGRNFTSNSVKAACWWAGIKQEFGIPYNPQSQGVVESMNRELKKIIGQIRDQAEHLKTAVQMAVFIHNFKRKGGIGGYSAGERIVDIIASDIQTKELQKQITKIQNFRVYYRDNRDPLWKGPAKLLWKGEGAVVIQDNNDIKVVPRRKVKIIRDYGKQMAGDDCVASRQDED

SEQ ID NO: 141 - protein, 1007 aa, Human immunodeficiency virus 1
FFRENLAFPQGEAREFPSEQTRANSPTSRANSPTSRELQVRGDNPRSEAGAERQGTLNFPQITLWQRPLVSIKVGGQIKEALLDTGADDTVLEEINLPGKWKPKMIGGIGGFIKVRQYDQILIEICGKKAIGTVLVGPTPVNIIGRNMLTQLGCTLNFPISPIETVPVKLKPGMDGPKVKQWPLTEEKIKALTAICEEMEKEGKITKIGPENPYNTPVFAIKKKDSTKWRKLVDFRELNKRTQDFWEVQLGIPHPAGLKKKKSVTVLDVGDAYFSVPLDEGFRKYTAFTIPSINNETPGIRYQYNVLPQGWKGSPAIFQSSMTKILEPFRAQNPEIVIYQYMDDLYVGSDLEIGQHRAKIEELREHLLKWGFTTPDKKHQKEPPFLWMGYELHPDKWTVQPIQLPEKDSWTVNDIQKLVGKLNWASQIYPGIKVRQLCKLLRGAKALTDIVPLTEEAELELAENREILKEPVHGVYYDPSKDLIAEIQKQGHDQWTYQIYQEPFKNLKTGKYAKMRTAHTNDVKQLTEAVQKIAMESIVIWGKTPKFRLPIQKETWETWWTDYWQATWIPEWEFVNTPPLVKLWYQLEKEPIAGAETFYVDGAANRETKIGKAGYVTDRGRQKIVSLTETTNQKTELQAIQLALQDSGSEVNIVTDSQYALGIIQAQPDKSESELVNQIIEQLIKKERVYLSWVPAHKGIGGNEQVDKLVSSGIRKVLFLDGIDKAQEEHEKYHSNWRAMASEFNLPPIVAKEIVASCDKCQLKGEAIHGQVDCSPGIWQLDCTHLEGKIILVAVHVASGYIEAEVIPAETGQETAYYILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQIIKIQNFRVYYRDSRDPIWKGPAKLLWKGEGAVVIQDNSDIKVVPRRKVKIIKDYGKQMAGADCVAGRQDEDQ

SEQ ID NO: 142 - protein, 1006 aa, Human immunodeficiency virus 1
FFRENLAFPQGEAREFPPEQTRANSPTRANSPTSRKLQVRGDNPCSEAGAERQGTFNFPQITLWQRPLVTIKVGGQVKEALLDTGADDTVLEEINLPGKWKPKMIGGIGGFIKVRQYDQIVIEICGKKAIGTVLIGPTPVNIIGRNMLTQLGCTLNFPISPIETVPVKLKPGMDGPKIKQWPLTEEKIKALTAICDEMEKEGKIEKIGPENPYNTPIFAIKKKDSTKWRKLVDFKELNKRTQDFWEVQLGIPHPAGLKKKRSVTVLDVGDAYFSVPLDESFRKYTAFTIPSINNETPGIRYQYNVLPQGWKGSPAIFQSSMTRILEPFRAKNPEIVIYQYMDDLYIGSDLEIGQHRAKVEELREHLLRWGFTTPDKKHQKEPPFLWMGYELHPDKWTVQPIQLPEKDSWTVNDIQRLVGKLNWASQIYPGIKVRQLCKLLRGTKALTDIVPLTEEAELELAENREILKEPVHGVYYDPSKDLIAEIQKQGDDQWTYQIYQESFKNLKTGKYAKMRSAHTNDVKQLTEAVQKIALESIVIWGKAPKFRLPIQKETWEIWWTDYWQATWIPDWEFVNTPPLVKLWYQLEKEPIAGAETFYVDGAANRETKIGKAGYVTDRGRQKVVTLTETTNQKTELQAIQLALQDSGLEVNIVTDSQYALGIIQAQPDKSESELVNQIIEELIKKERVYLSWVPAHKGIGENEQVDKLVSNGIRKVLFLDGIDKAQEEHEKYHSNWRAMANEFNLPPVVAKEIVASCDKCQLKGEAIHGQVDCSPGMWQLDCTHLEGKVILVAVHVASGYVEAEVIPAETGQETAYFILKLAGRWPVKIIHTDNGSNFTSNAVKAACWWAGIQQEFGIPYNPQSQGVVESMNKELKKIIGQVREQAEHLKTAVQMAVFIHNFKRRGGIGGYSAGERIIDIIASDIQTKELQKQITKIQNFRVYYRDSRDPVWKGPAKLLWKGEGAVVIQDNGDIKVVPRRKAKIIKDYGKQMAGDDCVAGRQDEDQ

SEQ ID NO: 143 - protein, 1013 aa, Human immunodeficiency virus 1
FFRENLAFQQGEAREFPSEQTRANSPTSRANSPTSRTNSPTSRELQVRGDNPRSEAGVERQGTLNFPQITLWQRPLVSIKVGGQIKEALLDTGADDTVLEDINLPGKWKPRMIGGIGGFIKVRQYDQIPIEICGKKAIGTVLVGPTPVNIIRRNMLTQLRCTLNFPISPIKTVPVKLKPGMDGPKVKQWPLTEEKIKALTEICEEMEKEGKITKIGPENPYNTPVFAIKKKDSTKWRKLVDFRELNKRTQDFWEVQLGIPHPSGLKKKKSVTVLDVEDAYFSVPLDEGFRKYTAFTIPSTNNETPGIRYQYNVLPQGWKGSPAIFQCSMTKILEPFRTQNPDIVIYQYMDDLYVGSDLEIGQHRAKIEELRAHLLKWGLTTPDKKHQKEPPFLWMGYELHPDKWTVQPIKLPEKDSWTVNDIQKIVGKLNWASQIYPGIKVKQLCKLLRGAKALTDIIPLTEEAELELAENREILKEPVHGAYYDPSKDLVAEIQKQGHDQWTYQIYQEPYKNLKTGKYAKMRTAHTNDVRQLTEAVQKIAQESIVIWGKTPKFRLPIQKETWETWWTDYWQATWIPEWEFINTPPLVKLWYQLEKEPIVGAETFYVDGAANRETKMGKAGYVTDKGRQKIVSLTETTNQKAELQAIQLALQDSGPEVNIVTDSQYALGIIQAQPDRSESELVNQIIEQLINKERIYLSWVPAHKGIGGNEQVDKLVSSGIRKVLFLDGIDKAQEDHEKYHNNWRAMASDFNLPPIVAREIVASCDKCQLKGEAMHGQVDCSPGVWQLDCTHLEGKIILVAVHVASGYMEAEVIPAETGQETAYYILKLAGRWPVKVIHTDNGSNFTSTAVKAACWWAGIKQEFGIPYNPQSQGVVEAMNKELKKIIEQVRDQAEHLKTAVQMAVLIHNFKRKGGIGGYSAGERIVDIIATDIQTRELQKQIIQIQNFRVYYRDSRDPIWKGPAKLLWKGEGAVVIQDNSDIKVVPRRKVKIIKDYGKQMAGADCVASRQDED

SEQ ID NO: 144 - protein, 1007 aa, Human immunodeficiency virus 1
FFRENLAFPQGKAREFPSEQARANSPTSRANSPTSRELQVRRDNPRSEAGAERQGTLNCPQITLWQRPLVSIKIGGQTREALLDTGADDTVLEEISLPGKWKPKMIGGIGGFIKVRQYDQILIEICGKKAIGSVLVGPTPVNIIGRNLLTQLGCTLNFPISPIETIPVKLKPGMDGPRVKQWPLTEEKIKALTAICEEMEKEGKISKIGPENPYNTPIFAIKKKDSTKWRKLVDFRELNKRTQDFWEIQLGIPHPAGLKKKKSVTVLDVGDAYFSVPLDEDFRKYTAFTIPSINNATPGIRYQYNVLPQGWKGSPSIFQSSMTKILEPFRAQNPEIVIYQYMDDLYVGSDLEIEQHRAKIEELREHLLKWGFTTPDKKHQKEPPFLWMGCELHPDKWTVQPIQLPEKESWTVNDIQKLVGKLNWASQIYAGIKVKQLCRLLRGAKALTDIVPLTAEAELELAENREILREPVHGVYYDPSKELIAEIQKQGQDQWTYQIYQEPFKNLKTGKYAKRRTAHTNDVKQLAEAVQKIAMESIVIWGKIPKFRLPIQKETWEAWWTDYWQATWIPEWEFVNTPPLVKLWYQLEKDPIAGVETFYVDGAANRETKLGKAGYVTDRGRQKIVSLSETTNQKTELHAIQLALQDSGSEVNIVTDSQYALRIIQAQPDKSESEIVNQIIEQLIKKERVYLAWVPAHKGIGENEQVDKLVSKGIRKVLFLDGIEKAQEEHERYHSNWRAMASEFNLPPIVAKEIVASCDKCQLKGEATHGQVDCSPGIWQLDCTHLEGKVIIVAVHVASGYIEAEVIPAETGQETAYFLLKLAGRWPVKTIHTDNGSNFTSAAVKAACWWAGIHQEFGIPYNPQSQGVVESMNKELKKIIGQVRDQAEHLKTAVLMAVFIHNFKRKGGIGDYSAGERIIDIIATDIQTKELQKQIIKIQNFRVYYRDNRDPIWKGPAKLLWKGEGAVVLQDNSDIKVIPRRKAKIIRDYGKQMAGADCVAGRQDENQ

SEQ ID NO: 145 - protein, 1007 aa, Human immunodeficiency virus 1
FFRENLAFPQGKAREFPSEQARANSPTSRANSPTSRELQVRRDNPRSEAGAERQGTLNLPQITLWQRPLVSIKVGGQIKEALLDTGADDTVLEDINLPGKWKPKMIGGIGGFIKVRQYDQIPIEICGKKAIGTVLVGPTPVNIIGRNMLTQLGCTLNFPISPIETIPVKLKPGMDGPKVKQWPLTEEKIKALTEICKEMEKEGKIEKIGPENPYNTPVFAIKKKDSTKWRKLVDFRELNKRTQDFWEVQLGIPHPSGLKKKKSVTVLDVEDAYFSVPLDENFRKYTAFTIPSVNNETPGIRYQYNVLPQGWKGSPAIFQCSMTKILEPFRTQNPEIVIYQYMDDLYVGSDLEIGQHRAKIEKLREHLLKWGFTTPDKKHQKEPPFLWMGYELHPDKWTVQPIKLPEKDSWTVNDIQRLVGKLNWASQIYAGIKVRQLCKLLRGAKALTDIVPLTKEAELELAENREILKEPVHGVYYDPSKELIAEIQKQGQDQWTYQIYQEPFKNLKTGKYAKRRTAHTNDVKQLAEAVQKITMESIVIWGRTPKFRLPIQKETWEAWWTDYWQATWIPEWEFVNTPPLVKLWYQLEKEPIAEAETFYVDGAANRETKMGKAGYVTDKGRQKIVSLTETTNQKTELHAIQLALQDSGPEVNIVTDSQYALGIIQAQPDKSESELVSQIIEQLINKERIYLSWVPAHKGIGGNEQVDKLVSKGIRKVLFLDGIDKAQEEHERYHSNWRAMANEFNLPPIVAREIVASCDKCQLKGEAIHGQVDCSPGVWQLDCTHLEGKIILVAVHVASGYVEAEVIPAETGQETAYFLLKLAGRWPVKTIHTDNGSNFTSAAVKAACWWAGVQQEFGIPYNPQSQGVVESMNKELKKIIGQIRDQAEHLKTAVQMAVFIHNFKRKGGIGDYSAGERIIDIIATDIQTRELQKQIIQIQNFRVYYRDSRDPVWKGPAKLLWKGEGAVVLQDNSDIKVVPRRKVKIIKDYGKQMAGADCVAGRQDENQ

SEQ ID NO: 146 - protein, 1006 aa, Human immunodeficiency virus 1
FFRENLAFPEGEAREFPSEQTRANSPTRANSPTSRKLQVRGDNPRSEAGVERQGTLNFPQITLWQRPLVSIKIGGQTREALLDTGADDTVLEEIKLPGNWKPKMIGGIGGFIKVRQYDQILIEICGKKAIGTVLIGPTPVNIIGRNLLTQLGCTLNFPISPIKTVPVKLKPGMDGPKVKQWPLSEEKIKALTEICEEMEKEGKISKIGPENPYNTPVFAIKKKDSTKWRKLVDFRELNKRTQDFWEIQLGIPHPAGLKKKKSVTVLDVGDAYFSVPLDEDFRKYTAFTIPSINNATPGIRYQYNVLPQGWKGSPSIFQSSMTKILEPFRAKNPEIVIYQYMDDLYVGSDLEIGQHRAKVEELREHLLKWGLTTPDKKHQKEPPFLWMGYELHPDKWTVQPIQLPDKDSWTVNDIQKLVGKLNWASQIYPGIKVKQLCKLLRGTKALTDIVPLTAEAELELAENREILREPVHGVYYDPSKDLVAEIQKQGNDQWTYQIYQEPYKNLKTGKYAKMRSAHTNDVKQLTEAVQKIALESIVIWGKAPKFRLPIQKETWEIWWTDYWQATWIPDWEFVNTPPLVKLWYQLEKDPIAGVETFYVDGAANRETKLGKAGYVTDRGRQKIVSLSETTNQKTELQAIQLALQDSGLEVNIVTDSQYALGIIQAQPDKSESELVNQIIEELIKKEKVYLSWVPAHKGIGENEQVDKLVSSGIRKVLFLDGIEKAQEEHEKYHNNWRAMASEFNLPPIVAKEIVASCDKCQLKGEATHGQVDCSPGMWQLDCTHLEGKIIIVAVHVASGYLEAEVIPAETGQDTAYYILKLAGRWPVKVIHTDNGTNFTSAAVKAACWWAGIQQEFGIPYNPQSQGVVESMNKELKKIIGQVREQAEHLKTAVLMAVFIHNFKRKGGIGEYSAGERIIDMIATDIQTKELQNQITKIQNFRVYYRDSRDPIWKGPAKLLWKGEGAVVIQDNGDIKVVPRRKVKIIRDYGKQMAGDDCVAGRQDEDQ

SEQ ID NO: 147 - protein, 1010 aa, Human immunodeficiency virus 1
FFRENLAFPQGEAREFPPEQTRANSPTSRTNSPTSRELQVRGDNPHSEAGAERQGTLQGTLNCPQITLWQRPLVSIRVGGQIKEALLDTGADDTVLEEISLPGKWKPKMIGGIGGFIKVRQYDQIVIEICGKKAIGSVLVGPTPVNIIRRNMLTQLRCTLNFPISSIETVPVKLKPGMDGPRVKQWPLTEEKIKALTAICEEMEKEGKITKIGPDNPYNTPVFAIKKKDSTKWRKLVDFKELNKRTQDFWEVQLGIPHPAGLKRKKSVTVLDVGDAYFSVPLDEGFRKYTAFTIPSTNNETPGIRYQYNVLPQGWKGSPAIFQSSMIKILEPFRAQNPDIVIYQYMDDLYIGSDLEIGQHRAKIEELRAHLLKWGFTTPDKKHQKEPPFLWMGCELHPDKWTVQPIQLPEKESWTVNDIQRLVGKLNWASQIYSGIKVRQLCKLLRGVKALTDIVPLTEEAELELAENREILKETVHGAYYDPSKDLIAEIQKQGHDQWTYQIYQEPFKNLKTGKYAKMRTAHTNDIKQLTEAVQKIAMESIVIWGKTPKFRLPIQKETWETWWTDYWQATWIPEWEFINTPPLVKLWYQLEKEPIVGAETFYVDGAANRDTKLGKAGYITDRGRQKVVTLTETTNQKAELQAIQLALQDSGSKVNIVTDSQYALGIIQAQPDRSESELVNQIIEQLIKKERVYLSWVPAHKGIGGNEQIDKLVSSGIRRVLFLDGIDKAQEDHEKYHSNWRAMASDFNLPPIVAKEIIASCDKCQLKGEAMHGQVDCSPGIWQLDCTHLEGKVIIVAVHVASGYIEAEVIPAETGQETAYYILKLAGRWPVKIIHTDNGSNFTSNAVKAACWWAGIHQEFGIPYNPQSQGVVEAMNKELKKIIGQVRDQAEHLKTAVLMAVFIHNFKRRGGIGGYSAGERIIDIIASDIQTKELQKQITKIQNFRVYYRDSRDPIWKGPAKLLWKGEGAVVIQDNSDIKVIPRRKAKIIKDYGKQMAGADCVAGGQDEN

SEQ ID NO: 148 - protein, 999 aa, Human immunodeficiency virus 1
FFRENLAFQQGEAREFPSEQTRAISPTSRELQVRGDNPCSEAGAERQGTFNFPQITLWQRPLVTIKVGGQVKEALLDTGADDTVLEEINLPGKWKPRMIGGIGGFIKVRQYEQILIEICGKRAIGTVLVGPTPINIIGRNMLTQIGCTLNFPISPIETVPVKLKPGMDGPKIKQWPLTEEKIKALTAICDEMEKEGKITKIGPENPYNTPIFAIKKKDSTKWRKLVDFRELNKRTQDFWEVQLGIPHPAGLKKKRSVTVLDVGDAYFSVPLDESFRKYTAFTIPSINNETPGIRYQYNVLPQGWKGSPAIFQSSMTRILEPFRAQNPEIVIYQYMDDLYVGSDLEIEQHRAKIEELREHLLRWGFTTPDKKHQKEPPFLWMGYELHPDKWTVQPIQLPEKDSWTVNDIQKIVGKLNWASQIYPGIKVRQLCRLLRGAKALTDIIPLTEEAELELAENREILKEPVHGAYYDPSKDLIAEIQKQGDDQWTYQIYQESFKNLKTGKYAKMRTAHTNDVRQLTEAVQKIAQESIVIWGKIPKFRLPIQKDTWETWWTDYWQATWIPDWEFVNTPPLVKLWYQLEKEPIAGAETFYVDGAANRETKIGKAGYVTDRGRQKVITLTETTNQKTELQAIHLALQDSGSEVNIVTDSQYALRIIQAQPDKSESEIVNQIIEQLINKERVYLSWVPAHKGIGGNEQVDKLVSNGIRKVLFLDGIDKAQEEHEKYHSNWRAMASEFNLPPVVAKEIVASCDKCQQKGEAIHGQVDCSPRIWQLDCTHLEGKVILVAVHVASGYMEAEVIPAETGQETAYFILKLAGRWPVKVIHTDNGSNFTSTAVKAACWWAGIKQEFGIPYNPQSQGVVESMNKELKKIIEQVRDQAEHLKTAVQMAVLIHNFKRKGGIGGYSAGERIVDIIATDIQTKELQKQIIKIQNFRVYYRDNRDPIWKGPAKLLWKGEGAVVIQDNSEIKVVPRRKAKIIRDYGKQMAGADCVASRQDED

SEQ ID NO: 149 - protein, 999 aa, Human immunodeficiency virus 1
FFRENLAFPQGKAREFPSEQTRAISPTSRELQVRGNNPRSEAGAERQGTLNLPQITLWQRPLVSIKIGGQTREALLDTGADDTVLEEIKLPGNWKPKMIGGIGGFIKVRQYDQILIEICGKRAIGTVLVGPTPVNIIGRNMLTQIGCTLNFPISSIETVPVKLKPGMDGPKVKQWPLTEEKIKALTEICEEMEKEGKITKIGPDNPYNTPVFAIKKKDSTKWRKLVDFKELNKRTQDFWEVQLGIPHPAGLKKNKSVTVLDVGDAYFSVPLDESFRKYTAFTIPSINNETPGIRYQYNVLPQGWKGSPAIFQSSMTRILEPFRAQNPDIVIYQYMDDLYVGSDLEIEQHRAKIEELREHLLRWGFTTPDKKHQKEPPFLWMGCELHPDKWTVQPIQLPEKDSWTVNDIQKLVGKLNWASQIYSGIKVRQLCKLLRGVKALTDIVPLTKEAELELAENREILREPVHGVYYDPAKDLIAEIQKQGQDQWTYQIYQEPFKNLKTGKYAKRRTAHTNDVKQLTEAVQKIATESIVIWGKIPKFRLPIQKDTWETWWTDYWQATWIPDWEFVNTPPLVKLWYQLEKEPIAEAETFYVDGAASRETKMGKAGYVTDRGRQKVITLTETTNQKTELQAIKLALQDSGSEVNVVTDSQYALGIIQAQPDKSESEIVNQIIEQLINKERVYLSWVPAHKGIGGNEQVDKLVSRGIRKVLFLDGIDKAQDEHEKYHSNWRAMASEFNLPPIVAREIVASCDKCQLKGEATHGQVDCSPGIWQLDCTHLEGKIILVAVHVASGYIEAEVIPTETGQETAYYILKLAGRWPVKIIHTDNGSNFTSSAVKAACWWAGIQQEFGIPYNPQSQGVVESMNKELKKIIGQVGDQAEHLKTAVQMAVFIHNFKRRGGIGGYSAGERIIDIIATDIQTRELQKQIIKIQNFQVYYRDSRDPIWKGPAKLLWKGEGAVVIQDNSEIKVVPRRKVKIIKDYGKQMAGADCMASRQDED

SEQ ID NO: 150 - protein, 1000 aa, Human immunodeficiency virus 1
FFRENLAFPQGEARELPSEQTRANGPTSRELQVRGDNPCSEAGAERQGTFNFPQITLWQRPLVTIKVGGQVKEALLDTGADDTVLEEINLPGKWKPKMIGGIGGFIKVRQYDQIPIEICGKRAIGTVLVGPTPINIIGRNMLTQLGCTLNFPISPIETVPVQLKPGMDGPRVKQWPLTEEKIKALTEICKEMEKEGKISKIGPENPYNTPIFAIKKKDSTKWRKLVDFRELNKRTQDFWEVQLGIPHPAGLKKKRSVTVLDVGDAYFSVPLDEDFRKYTAFTIPSINNETPGVRYQYNVLPQGWKGSPSIFQSSMTKILEPFRTQNPEIVIYQYMDDLYIGSDLEIGQHREKIEELREHLLKWGFTTPDKKHQKEPPFLWMGYELHPDKWTVQPIKLPEKDSWTVNDIQRLVGKLNWASQIYAGIKVRQLCKLLKGAKALTDIVTLTEEAELELAENREILKEPVYGVYYDPSKDLVAEIQKQGNDQWTYQIYQESFKNLKTGKYAKMRTAHTNDIKQLTEAVQKIAQESIVIWGKTPKFRLPIQKETWEAWWTDYWQATWIPDWEFVNTPPLVKLWYQLEKEPMAGVETFYVDGAANRETKIGKAGYVTDRGRQKVVTITETTNQKTELQAIYLALQDSGSKVNIVTDSQYALGIIQAQPDKSESELVSQIIEQLINKEKIYLSWVPAHKGIGGNEQVDKLVSSGIRKVLFLDGIDKAQEDHERYHSNWRAMASDFNLPPIVAKEIVASCDQCQLKGEAMHGQVDCSPGMWQLDCTHLEGKIIIVAVHVASGYIEAEVISAETGQETAYYILKLAGRWPVKVVHTDNGSNFTSAAVKAACWWAGVQQEFGIPYNPQSQGVVESMNKELKRIIGQVRDQAEHLKTAVQMAVFIHNFKRKGGIGGYSAGERIIDMIATDIQTKELQKQIIQIQNFRVYYRDSRDPIWKGPAKLLWKGEGAVVIQDKGDIKVVPRRKAKIIRDYGKQMAGADCMAGRQDEDQ

SEQ ID NO: 151 - protein, 1006 aa, Human immunodeficiency virus 1
FFREDLAFPQGEARKFPPEQTRANSPTSRANSPTSRKLQVRGDNPRSEAGVERQGTLNFPQITLWQRPLVSIKVGGQIREALLDTGADDTVLEEMSLPGKWKPKMIGGIGGFIKVKQYEQILIEICGKKAIGSVLVGPTPVNIIGRNLLTQLGCTLNFPISPIETVPVKLKPGMDGPKVKQWPLTEEKIKALTAICDEMEKEGKITKIGPENPYNTPVFAIKKKDSTKWRKLVDFKELNKRTQDFWEVQLGIPHPAGLKKKKSVTVLDVGDAYFSVPLDENFRKYTAFTIPSRNNETPGIRYQYNVLPQGWKGSPAIFQASMTKILEPFRAKNPEIVIYQYMDDLYVGSDLEIGQHRAKIEELRDHLLKWGFTTPDKKHQKEPPFLWMGYELHPDKWTVQPIELPEKDSWTVNDIQKLVGKLNWASQIYPGIQVKQLCKLLRGAKALTDVVPLTEEAELELAENREILKEPVHGAYYDPSKDLIAEIQKQGHDQWTYQIYQEPYKNLKTGKYAKRRAAHTNDVKQLTEAVQKIAMESIVIWGKTPKFRLPIQKETWETWWTEYWQATWIPEWEFVNTPPLVKLWYQLEKEPIAGAETFYVDGAANRETKMGKAGYITDRGRQKIISLTETTNQKTELHAIQLALQDSGSEANIVTDSQYALGIIQAQPDRSESELVNQIIEQLIKKERVYLAWVPAHKGIGENEQVDKLVSSGIRKILFLDGIDKAQEEHEKYHSNWKAMASEFNLPPVVAREIVASCDKCQLKGEAMHGQVDCSPRIWQLDCTHLERKVILVAVHVASGYMEAEVIPAETGQETAYFILKLAGRWPVKVIHTDNGSNFTSNAVKAACWWAGIHQEFGIPYNPQSQGVVESMNKELKKIIEQVRDQAEHLKTAVQMAVLIHNFKRKGGIGGYTAGERIIDIIATDIQTKELQNQITKIQNFRVYYRDNRDPIWKGPAKLLWKGEGAVVLQDNSDIKVVPRRKVKIIRDYGKQMAGADCVAGRQDED

SEQ ID NO: 152 - protein, 1003 aa, Human immunodeficiency virus 1
FFRKNLAFPQGEAREFPPEQTRANSPTSRELQVRGDNPLSEAGAERQGTLQGTLNCPQITLWQRPLVSIKVGGQIKEALLDTGADDTVLEEISLPGKWKPKMIGGIGGFIKVRQYDQIVIEICGKKAIGAVLVGPTPVNIIRRNMLTQLRCTLNFPISPIKTVPVKLKPGMDGPKVKQWPLSEEKIKALTAICEDMEKEGKITKIGPENPYNTPIFAIKKKDSTKWRKLVDFRELNKRTQDFWEVQLGIPHPSGLKKKKSVTVLDVEDAYFSVPLDEGFRKYTAFTIPSINNATPGIRYQYNVLPQGWKGSPAIFQSSMTKILEPFRTKNPDIVIYQYMDDLYVGSDLEIGQHRAKIEKLREHLLRWGLTTPDKKHQKEPPFLWMGYELHPDKWTVQPIQLPDKDSWTVNDIQKLVGKLNWASQIYAGIKVKQLCRLLRGAKALTDIIPLTEEAELELAENREILKEPVHGAYYDPSKDLIAEIQKQGQGQWTYQIYQEPYKNLKTGKYAKMRTAHTNDVKQLAEAVQKITMESIVIWGRTPKFRLPIQKETWETWWTDYWQATWIPEWEFINTPPLVKLWYQLEKEPIVGAETFYVDGAANRETKLGKAGYVTDKGRQKIVSLTETTNQKTELQAIHLALQDSGSEVNIVTDSQYALRIIQAQPDKSESELVNQIIEQLINKERIYLSWVPAHKGIGGNEQVDKLVSNGIRKVLFLDGIEKAQEEHERYHSNWRAMANEFNLPPIVAREIVASCDKCQIKGEAMHGQVDCSPGVWQLDCTHLEGKVILVAVHVASGYVEAEVIPAETGQEAAYFILKLAGRWPVKTIHTDNGSNFTSTAVKAACWWAGIKQEFGIPYNPQSQGVVESMNKELKKIIGQVRDQAEHLKTAVQMAVLIHNFKRKGGIGDYSAGERIIDIIATDMQTKELQKQIIKVQNFRVYYRDSRDPIWKGPAKLLWKGEGAVVIQDNGDIKVVPRRKVKIIKDYGRQMAGADCVASRQDED

SEQ ID NO: 153 - protein, 1000 aa, Human immunodeficiency virus 1
FFRENLAFPEGEAREFPSEQARANSPTSRELQVRRDNPRSEAGAEGQGTLNFPQITLWQRPLVSIRVGGQIKEALLDTGADDTVLEEINLPGRWKPKMIGGIGGFIKVRQYDQITIEICGKKAIGTVLVGPTPINIIGRNMLTQIGCTLNFPISPIETVPVKLKPGMDGPKIKQWPLTEEKIKALKAICEEMEKEGKIEKIGPENPYNTPVFAIKKKDSTKWRKLVDFRELNKRTQDFWEIQLGIPHPAGLKRKKSVTVLDVGDAYFSVPLYEDFRKYTAFTIPSVNNETPGIRYQYNVLPQGWKGSPAIFQCSMTKILEPFRAQNPEIVIYQYMDDLYVGSDLEIGQHRAKVEELREHLLKWGLTTPDKKHQKEPPFLWMGYELHPDKWTVQPIQLPEKESWTVNDIQKIVGKLNWASQIYPGIKVRQLCRLLRGAKALTDIVPLTAEAELELAENREILKEPVHGVYYDPSKELIAEIQKQGDDQWTYQIYQEPFKNLKTGKYAKMRSAHTNDVKQLTEAVQKIALESIVIWGKAPKFRLPIQKETWEIWWTDYWQATWIPEWEFINTPPLVKLWYQLEKEPIAGVETFYVDGAANRDTKIGKAGYVTDRGRQKIVSLSETTNQKTELQAIQLALQDSGLEVNIVTDSQYALGIIQAQPDNSESELVNQIIEELIKKERVYLSWVPAHKGIGGNEQVDKLVSKGIRKVLFLDGIDKAQEEHEKYHNNWRAMASDFNLPPVVAKEIVACCDKCQLKGEAIHGQVDCSPGIWQLDCTHLEGKVIIVAVHVASGYLEAEVIPAETGQETAYFLLKLAGRWPVKVIHTDNGPNFTSAAVKAACWWAGINQEFGIPYNPQSQGVVESMNKELKKIIGQVREQAEHLKTAVQMAVFIHNFKRKGGIGGYSAGERIVDIIATDIQTKELQNQIIKIQNFRVYYRDSRDPIWKGPAKLLWKGEGAVVIQENSDIKVVPRRKAKIIKDYGKQMAGDDCVAGRQDEDQ

SEQ ID NO: 154 - protein, 1012 aa, Human immunodeficiency virus 1
FFRENLAFQQGEAREFPSEQTRANSPTRANSPTSRTNSPTSRELQVRGDNPHSEAGAERQGSLNFPQITLWQRPLVTIKIGGQLKEALLDTGADDTVLEDINLPGKWKPRMIGGIGGFIKVRQYEQIPIEICGKKAIGTVLIGPTPVNIIGRNLLTQLGCTLNFPISPIETIPVKLKPGMDGPKVKQWPLTEEKIKALTAICEEMEKEGKITKIGPDNPYNTPVFAIKKKDSTKWRKLVDFRELNKRTQDFWEVQLGIPHPAGLKKKKSVTVLDVGDAYFSVPLDKDFRKYTAFTIPSTNNETPGIRYQYNVLPQGWKGSPAIFQSSMIKILEPFRAKNPELVIYQYMDDLYVGSDLEIMQHRAKIEELRAHLLKWGFTTPDKKHQKEPPFLWMGYELHPDKWTVQPIVLPEKDSWTVNDIQKLVGKLNWASQIYPGIKVKQLCKLLRGTKALTDIVPLTEEAELELAENREILKETVHGAYYDPSKDLIAEIQKQGYDQWTYQIYQEPFKNLKTGKYAKKRTAHTNDVRQLTEAVQKIAIESIVIWGKTPKFRLPIQKETWETWWADYWQATWIPEWEFVNTPPLVKLWYQLEKDPIAGAETFYVDGAANRETKKGKAGYVTDKGRQKVVTLTETTNQKAELQAIQLALQDSGPEVNIVTDSQYALRIIQAQPDKSESGLVNQIIEQLIKKEKVYLSWVPAHKGIGGNEQIDKLVSSGIRRVLFLDGIDKAQEDHEKYHSNWRAMAGEFNLPPVVAKEIVASCDKCQQKGEAIHGQVDCSPGIWQLDCTHLEGKIILVAVHVASGYIEAEVIPAETGQDTAYYILKLAGRWPVKVIHTDNGTNFTSAAVKAACWWASIQQEFGIPYNPQSQGVVEAMNKELKKIIGQIRDQAEHLKTAVLMAVFIHNFKRKGGIGEYSAGERIIDIIASDIQTKELQKQITKIQNFRVYYRDSRDPVWKGPAKLLWKGEGAVVIQDNSDIKVIPRRKAKIIRDYGKQMAGADCVAGGQDED

SEQ ID NO: 155 - protein, 1007 aa, Human immunodeficiency virus 1
FFRENLAFPQGEAREFPSEQTRANSPTSRANSPTSRELQVRGDNPRSEAGAERQGTLNFPQITLWQRPLVTIKIGGQLKEALLDTGADDTVLEDINLPGKWKPKMIGGIGGFIKVRQYDQILIEICGKKAIGTVLVGPTPVNIIGRNMLTQIGCTLNFPISPIETVPVKLKPGMDGPKVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDESFRKYTAFTIPSINNETPGIRYQYNVLPQGWKGSPAIFQSSMTKILEPFRKQNPDIVIYQYMDDLYVGSDLEIGQHRAKIEELREHLLKWGFTTPDKKHQKEPPFLWMGYELHPDKWTVQPIQLPEKDSWTVNDIQKLVGKLNWASQIYPGIKVKQLCKLLRGAKALTDIVPLTEEAELELAENREILKEPVHGVYYDPSKDLIAEIQKQGQDQWTYQIYQEPFKNLKTGKYAKMRTAHTNDVKQLTEAVQKIATESIVIWGKTPKFRLPIQKETWETWWTDYWQATWIPEWEFVNTPPLVKLWYQLEKEPIVGAETFYVDGAANRETKLGKAGYVTDRGRQKVVSLTETTNQKTELQAIQLALQDSGSEVNIVTDSQYALGIIQAQPDKSESELVNQIIEQLIKKEKVYLSWVPAHKGIGGNEQVDKLVSSGIRKVLFLDGIDKAQEEHEKYHSNWRAMASDFNLPPIVAKEIVASCDKCQLKGEAMHGQVDCSPGIWQLDCTHLEGKVILVAVHVASGYIEAEVIPAETGQETAYFILKLAGRWPVKVIHTDNGSNFTSAAVKAACWWAGIQQEFGIPYNPQSQGVVESMNKELKKIIGQVRDQAEHLKTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDEDQ

SEQ ID NO: 156 - protein, 1007 aa, Human immunodeficiency virus 1
FFRENLAFPQGEAREFPSEQTRANSPTSRANSPTSRELQVRGDNPRSEAGAERQGTLNFPQITLWQRPLVSIKVGGQIKEALLDTGADDTVLEEINLPGKWKPKMIGGIGGFIKVRQYDQIPIEICGKRAIGTVLVGPTPINIIGRNMLTQLGCTLNFPISPIKTVPVKLKPGMDGPKVKQWPLTEEKIKALTAICEEMEKEGKITKIGPENPYNTPVFAIKKKDGTKWRKLVDFRELNKRTQDFWEVQLGIPHPSGLKKKKSVSVLDVGDAYFSVPLDESFRKYTAFTIPSINNETPGIRYCYNVLPQGWKGSPAIFQCSMTKILEPFRAQNPEIVIYQYMDDLYIGSDLEIGQHRAKIEELREHLLRWGFTTPDKKHQKEPPFLWMGCELHPDKWTVQPIQLPEKDSWTVNDIQKIVGKLNWASQIYPGIKVRQLCKLLRGAKALTDIVPLTEEAELELAENREILREPVHGVYYDPSKDLVAEIQKQGQDQWTYQIYQEPFKNLKTGKYAKMRTAHTNDVKQLTEAVQKIALESIVIWGKIPKFRLPIQKETWEAWWMEYWQATWIPEWEFINTPPLVKLWYQLEKEPIAGAETFYVDGAANRETKIGKAGYVTDRGRQKIVSLTETTNQKAELQAIQLALQDSGPEVNIVTDSQYALGIIQAHPDKSESELVNQIIEQLIKKERVYLSWVPAHKGIGENEQVDKLVSNGIRKILFLDGIDKAQEEHEKYHSNWRAMASEFNLPPIVAKEIVASCNKCQLKGEALHGQVDCSPGMWQLDCTHLEGKVILVAVHVASGYMEAEVIPAETGQETAYYILKLAGRWPVKVVHTDNGSNFTSTAVKAACWWAGIQQEFGIPYNPQSQGVIESMNKELKKIIGQIRDQAEHLKTAVQMAVFIHNFKRKGGIGEYSAGERIIDIIATDIQTRELQKQIIKIQNFRVYYRDSRDPIWKGPAKLLWKGEGAVVLQDNSDIKVVPRRKVKIIKDYGKQMAGADCVAGRQDENQ

SEQ ID NO: 157 - protein, 1004 aa, Human immunodeficiency virus 1
FFRENLAFQQGEARKFSSEQTGANSPTSRELRVRRGDNPLSEAGAERRGTVPSLSFPQITLWQRPLVTVKIGGQLIEALLDTGADDTVLEDINLPGKWKPRMIGGIGGFIKVKQYDQILIEICGKKAIGTVLVGPTPVNIIGRNMLTQIGCTLNFPISPIDTVPVTLKPGMDGPKIKQWPLTEEKIKALTEICTEMEKEGKISRIGPENPYNTPIFAIKKKDSTKWRKLVDFRELNKKTQDFWEVQLGIPHPAGLKKKRSVTVLDVGDAYFSVPLDKDFRKYTAFTIPSTNNETPGIRYQYNVLPQGWKGSPSIFQSSMTRILEPFRAKNPEIVIYQYMDDLYVGSDLEIEQHRTKIEELRQHLLRWGLTTPDKKHQKEPPFLWMGYELHPDRWTVQPIELPEKESWTVNDIQKLVGKLNWASQIYAGIKVKQLCKLLRGTKALTEVVPLTEEAELELEENREILKDPVHGAYYDPSKDLIAEIQKQGHDQWTYQIYQEQYKNLKTGKYARKRSAHTNDVRQLTEAVQKIATESIVIWGKTPKFRLPIQRETWETWWTDYWQATWIPEWEFVNTPPLVKLWYQLEKDPIAGVETFYVDGASNRETKKGKAGYVTDKGRQKVVSLTETTNQKTELHAIHLALQDSGSEVNIVTDSQYALGIIQAQPDRSESELVNQIIEELIKKEKVYLSWVPAHKGIGGNEQVDKLVSSGIRKVLFLDRIDKAQEEHERYHSNWRTMASDFNLPPIVAKEIVANCDKCQLKGEAMHGQVDCSPGIWQIDCTHLEGKVIIVAVHVASGYIEAEVIPAETGQETAYFLLKLAGRWPVKVIHTDNGSNFTSAAVKAACWWANVTQEFGIPYNPQSQGVVESMNKELKKIIGQVREQAEHLKTAVQMAVLIHNFKRKGGIGGYSAGERIIDIIASDIQTKELQKQIIKVQNFRVYYRDSRDPVWKGPAKLLWKGEGAVVIQDNSDIKVVPRRKVKIIRDYGKQMAGDDCVAGRQDEDQ

SEQ ID NO: 158 - protein, 1003 aa, Human immunodeficiency virus 1
FFREDLAFPQGKAREFSSEQTRANSPTRRELQVWGRDNNSLSEAGADRQGTVSFSFPQITLWQRPLVTIKIGGQLKEALLDTGADDTVLEEMNLPGRWKPKMIGGIGGFIKVRQYDQILIEICGHKAIGTVLIGPTPVNIIGRNLLTQIGCTLNFPISPIETVPVKLKPGMDGPRVKQWPLTEEKIKALVEICTEMEKEGKISKIGPENPYNTPVFAIKKKDSTRWRKLVDFRELNKRTQDFWEIQLGIPHPAGLKKKKSVTVLDVGDAYFSVPLDEGFRKYTAFTIPSVNNETPGVRYQYNVLPQGWKGSPAIFQSSMTKILEPFRKQNPDIVIYQYMDDLYVGSDLEIGQHRTKIEELREHLLKWGFTTPDKKHQNEPPFLWMGYELHPDKWTVQPIVLPEKDSWTVNDLQKLVGKLNWASQIYPGIKVKQLCRLLRGAKALTEVIPLTKEAELELAENREILKEPVHGVYYDPSKELIAEIQKQGQGQWTYQIYQEPYKNLKTGKYARMRGAHTNDVKQLTEVVQKIAMESIVIWGKTPKFKLPIQKETWETWWTEYWQATWIPDWEFVNTPPLVKLWYQLEKEPIVGAETFYVDGAANRETKLGKAGYVTDRGRQKVVSLTDTTNQKTELQAIHLALQDSGLEVNIVTDSQYAIGIIQAQPDKSESELVSQIIEQLIKKEKVYLAWVPAHKGIGGNEQVDKLVSAGIRKVLFLDGIDKAQEDHEKYHNNWRAMASDFNLPPVVAKEIVASCDKCQLKGEAIHGQVDCSPGIWQLDCTHLEGKIILVAVHVASGYLEAEVIPAETGQETAYFILKLAGRWPVKTIHTDNGSNFTSTTVKAACWWAGIKQEFGIPYNPQSQGVVESINKELKKIIGQVRDQAEHLKTAVLMAVFIHNFKRRGGIGGYSAGERIVDIIATDIQTKELQKQITKIQNFRVYYRDSRDPLWKGPAKLLWKGEGAVVIQDNSEIKVVPRRKAKIIRDYGKQMAGDDCVASRQDED

SEQ ID NO: 159 - protein, 1004 aa, Human immunodeficiency virus 1
FFRENLAFQQGEARKFSSEQTRANSPTRGELQVWGRDNNPLSEAGAERRGTVPSLSFPQITLWQRPLVTVKIGGQLIEALLDTGADDTVLEDINLPGKWKPKMIGGIGGFIKVKQYDQILIEICGKKAIGTVLVGPTPVNIIGRNMLTQIGCTLNFPISPIDTVPVTLKPGMDGPRIKQWPLTEEKIKALTEICKEMEEEGKISKIGPENPYNTPIFAIKKKNSTRWRKLVDFRELNKKTQDFWEVQLGIPHPAGLKRKKSVTVLDVEDAYFSVPLDESFRKYTAFTIPSINNETPGVRYQYNVLPQGWKGSPAIFQCSMTKILEPFRIKNPEMVIYQYMDDLYVGSDLEIGQHRIKIEELRAHLLSWGFTTPDKKHQKDPPFLWMGYELHPDRWTVQPIELPEKDSWTVNDIQKLVEKLNWASQIYSGIKVRQLCRLLRGAKALTDIVPLTEEAELELAENREILKEPVHGAYYDPSKDLVAEIQKQGQDQWTYQIYQEPFKNLKTGKYARKRSAHTNDVKQLTEVVQKIATESIVIWGKTPKFRLPIQRETWETWWTEYWQATWIPEWEFVNTPPLVKLWYQLEKDPIAGVETFYVDGAASRETKLGKAGYVTDRGRQKVVSLTETTNQKTELHAIHLALQDSGSEVNIVTDSQYVLGIIQAQPDRSESELVNQIIEELIKKEKVYLSWVPAHKGIGGNEQVDKLVSSGIRKVLFLNGIDKAQEEHERYHSNWRTMASDFNLPPIVAKEIVANCDKCQLKGEAMHGQVDCSPGVWQLDCTHLEGKVIIVAVHVASGYIEAEVIPAETGQEAAYFILKLAGRWPVKVVHTDNGSNFTSAAVKAACWWANVRQEFGIPYNPQSQGVVESMNNELKKIIGQIRDQAEHLKTAVLMAVFIHNFKRKGGIGEYSAGERIIDIIATDIQTRELQKQITKIQNFRVYFRDSRDPIWKGPAKLLWKGEGAVVIQDNSEIKVVPRRKVKIIRDYGKQMAGDDCVAGRQDEN

SEQ ID NO: 160 - protein, 1008 aa, Human immunodeficiency virus 1
FFRENLAFPQGEAREFPSEQARANSPTSRANSPTSRDLWDGGRDNLPSEAGAERQGTLNFPQITLWQRPLVTVRIGGQLREALLDTGADDTVLEDIDLPGKWKPKIIGGIGGFIKVRQYEQIPIEICGHKAIGTVLVGPTPINIIGRNMLTQLGCTLNFPISPIKTVPVKLKPGMDGPRVKQWPLTEEKIKALTAICEEMEKEGKITKIGPENPYNTPVFAIKKKDSTRWRKLVDFRELNRRTQDFWEVQLGIPHPAGLKKKRSVTVLDVGDAYFSVPLDEGFRKYTAFTIPSVNNETPGIRYQYNVLPQGWKGSPSIFQSSMTRILEPFRAKNPEIVIYQYIDDLYVRSDLEIGQHRAKIEELREHLLRWGFTTPDKKHQKEPPFLWMGCELHPDKWTVQPIQLPEKDSWTINDIQKLVGKLNWASQIYPGIKVRQLCKLLRGTKALTDIVTLTEEAELELAENREILKDPVHGVYYDPSKELIAEIQKQGDDQWTYQIYQEQYKNLKTGKYAKRRTAHTNDVRQLTEAVQKIALESIVIWGKIPKFRLPIQKETWEAWWMEYWQATWIPEWEYVNTPPLVKLWYQLEKEPIIGAETFYVDGAANRETKLGKAGYVTNRGRQKVVSLTDTTNQKTELQAIQLALQDSGSEVNVVTDSQYALGIIQAHPDKSESELVNQIIEQLIKKERVYLSWVPAHKGIGGNEQVDKLVSAGIRKVLFLDGIDKAQEDHERYHSNWRAMASDFNLPPVVAKEIVASCNKCQLKGEAIHGQVDCSPGIWQLDCTHLEGKIIIVAVHVASGYMEAEVIPAETGQETAYFILKLAGRWPVKIIHTDNGSNFTSATVKAACWWANVTQEFGIPYNPQSQGVVESINKELKKIIGQVRDQAEHLRTAVQMAVFIHNFKRRGGIGGYSAGERIVDIIATDIQTKELQKQITKIQKFRVYYRDSRDPLWKGPAKLLWKGEGAVVIQDNSDIKVIPRRKAKIIKDYGKQMAGADCVAGRQDEDQ

SEQ ID NO: 161 - protein, 1006 aa, Human immunodeficiency virus 1
FFRENLAFPQGKAREFPSEQTRANSPTSRANSPTSRELQVRGDNPRSEAGAERQGTFNFPQITLWQRPLVSIKVGGQIKEALLDTGADDTVLEEINLPGKWKPRMIGGIGGFIKVRQYDQILIEICGKRAIGTVLVGPTPANIIGRNLLTQLGCTLNFPISPIETVPVKLKPGMDGPKIKQWPLTEEKIKALTEICTEMEKEGKISKIGPENPYNTPIFAIKKKDSTKWRKLVDFKELNKRTQDFWEVQLGIPHPSGLKKKKSVTVLDVGDAYFSVPLDEDFRKYTAFTIPSTNNETPGIRYQYNVLPQGWKGSPAIFQASMTKILEPFRAQNPEIVIYQYMDDLYVGSDLEIEQHRAKVEELREHLLKWGFTTPDKKHQNEPPFLWMGYELHPDKWTVQPIKLPEKESWTVNDIQKLVGKLNWASQIYPGIKVKQLCRLLRGTKALTEVIPLTKEAELELAENREILREPVHGVYYDPTKDLIAEIQKQGHDQWTYQIYQEPHKNLKTGKYAKMRTAHTNDVKQLAEAVQKIAMESIVIWGKIPKFKLPIQKETWETWWTDYWQATWIPDWEFVNTPPLVKLWYQLEKEPIAGAETFYVDGAANRETKIGKAGYVTDRGRQKIVSLTETTNQKAELQAIQLALQDSGPEVNIVTDSQYALGIIQAQPDKSESEIVNQIIEKLIEKDKVYLSWVPAHKGIGGNEQIDKLVSNGIRKVLFLDGIEKAQEEHEKYHSNWRAMASEFNLPPIVAKEIVASCDKCQLKGEATHGQVDCSPGMWQLDCTHLEGKIILVAVHVASGYIEAEVIPTETGQETAYYILKLAGRWPVKVIHTDNGSNFTSTAVKAACWWAGIQQEFGIPYNPQGQGVVESMNKELKKIIGQVREQAEHLKTAVQMAVLIHNFKRKGGIGGYSAGERIIDIIASDIQTKELQKQIIKVQNFRVYYRDSRDPIWKGPAKLLWKGEGAVVLQDNSDIKVVPRRKVKIIKDYGKQMAGADCVASRQDEN

SEQ ID NO: 162 - protein, 1003 aa, Human immunodeficiency virus 1
FFREDLAFPQGKAREFSSEQTRANSPTRRELQVWGRDNNSLSEAGADRQGTVSFSFPQITLWQRPLVTIKIGGQLKEALLDTGADDTVLEEMNLPGRWKPKMIGGIGGFIKVRQYDQIPIEICGKKAIGTVLIGPTPVNIIGRNLLTQIGCTLNFPISPIETIPVKLKPGMDGPKVKQWPLTEEKIKALVEICTEMEKEGKISRIGPENPYNTPVFAIKKKDGTKWRKLVDFRELNKRTQDFWEIQLGIPHPAGLKKKKSVSVLDVGDAYFSVPLDKDFRKYTAFTIPSINNETPGIRYCYNVLPQGWKGSPAIFQSSMTKILEPFRKQNPDIVIYQYMDDLYIGSDLEIGQHRTKIEELRQHLLRWGLTTPDKKHQNEPPFLWMGYELHPDKWTVQPIVLPEKDSWTVNDLQKLVGKLNWASQIYAGIKVKQLCKLLRGAKALTEVVPLTEEAELELEENREILKEPVHGVYYDPSKDLIAEIQKQGQGQWTYQIYQEPYKNLKTGKYARMRGAHTNDVKQLTEAVQKIAQECIVIWGKTPKFKLPIQKETWETWWMDYWQATWIPEWEFINTPPLVKLWYQLEKEPIVGAETFYVDGASNRETKKGKAGYVTDKGRQKVVTLTETTNQKTELQAIHLALQDSGLEVNIVTDSQYAIGIIQAQPDKSESELVSQIIEQLIKKEKVYLAWVPAHKGIGGNEQVDKLVSNGIRKILFLDGIDKAQEEHEKYHNNWRAMASDFNIPPVVAKEIVACCDKCQLKGEALHGQVDCSPRIWQLDCTHLEGKVILVAVHVASGYLEAEVIPAETGQETAYFLLKLAGRWPVKTIHTDNGSNFTSTTVKAACWWAGIKQEFGIPYNPQSQGVIESMNKELKKIIEQVRDQAEHLKTAVQMAVFVHNFKRKGGIGDYSAGERIIDIISTDIQTRELQKQIIKIQNFRVYYRDSRDPVWKGPAKLLWKGEGAVVIQDNNEIKVVPRRKAKIIRDYGKQMAGDDCVASRQDED

SEQ ID NO: 163 - protein, 1003 aa, Human immunodeficiency virus 1
FFREDLAFPQGEARKFPSEQTRANSPTRGELQVWGRDNNSLSEAGDDRQGTVSFNLPQITLWQRPLVTVRIGGQLIEALLDTGADDTVLEDMNLPGKWKPKMIGGIGGFIKVRQYEQIPIEICGHKAIGTVLIGPTPVNIIGRNLLTQIGCTLNFPISPIDTVPVTLKPGMDGPKIKQWPLTEEKIKALTEICTEMEKEGKISRIGPENPYNTPVFAIKKKNSTRWRKLVDFRELNKRTQDFCEVQLGIPHPAGLKKKRSVTVLDVGDAYFSVPLDENFRKYTAFTIPSINNETPGVRYQYNVLPQGWKGSPAIFQASMTKILEPFRTKNPELVIYQYMDDLYVGSDLEIEQHRTKIEELRAHLLSWGFTTPDKKHQKEPPFLWMGYELHPDKWTVQPIELPEKDSWTVNDIQKIVGKLNWASQIYPGIKVRQLCRLLRGTKALTDIVPLTAEAELELAENREILREPVHGVYYDPSKELIAEIQKQGHDQWTYQIYQDPFKNLKTGKYARKRSAHTNDVRQLTEAVQKITTESIVIWGKTPKFRLPIQRETWEAWWMEYWQATWIPEWEFINTPPLVKLWYQLEKDPIVGAETFYVDGAASRETKLGKAGYVTNKGRQKVVSLNETTNQKTELHAIHLALQDSGSEANIVTDSQYALGIIQAQPDRSESEVVNQIIEELIKKEKVYLSWVPAHKGIGGNEQVDKLVSSGIRKVLFLDGIDKAQEDHERYHSNWRTMASDFNLPPIVAREIVASCDKCQQKGEAMHGQVDCGPGIWQLDCTHLERKVILVAVHVASGYIEAEVIPAETGQETAYFVLKLAGRWPVKVIHTDNGSNFTSAAVKAACWWANVTQEFGIPYNPQSQGVVESMNNELKKIIGQVREQAEHLKTAVLMAVFIHNFKRKRGIGGYSAGERIVDIIASDIQTKELQNQITKIQNFRVYFRDSRDPIWKGPAKLLWKGEGAVVIQDNNDIKVVPRRKVKIIRDYGKQMAGDDCVAGRQDEN

SEQ ID NO: 164 - protein, 1000 aa, Human immunodeficiency virus 1
FFREDLAFQQGEARKFSSEQTRANSPTSRELRVWGGDNTLSETGAERQGTLNFPQITLWQRPLVTIKVGGQIKEALLDTGADDTVLEDINLPGKWKPRMIGGIGGFIKVRQYDQIPIEICGKKAIGSVLVGPTPVNIIGRNMLTQLGCTLNFPISPIKTVPVKLKPGMDGPKVKQWPLSEEKIKALTAICDEMEKEGKITKIGPDNPYNTPVFAIKKKDGTKWRKLVDFKELNKRTQDFWEIQLGIPHPAGLKKKKSVSVLDVGDAYFSVPLDESFRKYTAFTIPSLNNETPGIRYCYNVLPQGWKGSPAIFQSSMTKILEPFRAQNPEIVIYQYIDDLYVRSDLEIGQHRAKIEELREHLLKWGLTTPDKKHQKEPPFLWMGYELHPDRWTVQPIQLPDKDSWTVNDLQKLVGKLNWASQIYPGIRVKQLCKLLKGAKALTDIVTLTEEAELELAENREILKNPVHGVYYDPAKDLIAEIQKQGNDQWTYQIYQEPHKNLKTGKYAKMRTAHTNDVKQLTEVVQKIAMESIVIWGKVPKFRLPIQKETWETWWTDYWQATWIPDWEFVNTPPLVKLWYQLEKEPIAGAETFYVDGAANRETKMGKAGYVTDRGRQKVVSLTETTNQKTELQAIQLALQDSGPEVNIVTDSQYAIGIIQAQPDKSESEIVNQIIEQLIKKERVYLSWVPAHKGIGENEQVDKLVSTGIRRVLFLDGIDKAQEEHERYHSNWRAMASEFNLPPIVAKEIVASCDQCQLKGEAMHGQVDCSPGVWQLDCTHLEGKIILVAVHVASGYMEAEVIPAETGQETAYFILKLAARWPVKVIHTDNGPNFTSATVKAACWWANITQEFGIPYNPQGQGVVESMNKELKKIIKQVRDQAEHLKTAVQMAVLIHNFKRKGGIGGYSAGERIIDIIASDIQTKELQKQIIKIQNFQVYYRDSRDPIWKGPAKLLWKGEGAVVLQDNSDIKVVPRRKVKIIKDYGKQMAGADCVAGGQDED

SEQ ID NO: 165 - protein, 1003 aa, Human immunodeficiency virus 1
FFRENLAFPQGKAREFPSEQTRAISPTSRELQVWGGDNNSLSEAGAERQGTVSFSFPQITLWQRPIVTIKIGGQLREALLDTGADDTVLEEMNLPGRWKPKMIGGIGGFIKVKQYDNILIEICGHKAVGTVLVGPTPANIIGRNLLTQLGCTLNFPISPIETVPVKLKPGIDGPKVKQWPLTEEKIKALVEICTEMEKEGKISKIGPENPYNTPIFAIKKKDSTRWRKLVDFRELNRRTQDFWEVQLGIPHPAGLKRKKSVTVLDVGDAYFSVPLDKEFRKYTAFTIPSINNETPGIRYQYNVLPQGWKGSPSIFQSSMTKILEPFRIKNPEMVIYQYMDDLYIGSDLEIGQHRIKIEELREHLLKWGFTTPDKKHQKEPPFLWMGCELHPDKWTVQPIMLPEKDSWTVNDIQKLVGKLNWASQIYAGIKVRQLCKLLRGTKALTEVVPLTEEAELELAENREILKEPVHGAYYDPSKDLIAEVQKQGQDQWTYQIYQEPFKNLKTGKYAKKRSAHTNDVKQLTEAVQKIALESIVIWGKAPKFRLPIQKETWEAWWTEYWQATWVPEWEFVNTPPLVKLWYQLETEPIAGAETYYVDGAANRETKLGKAGYVTNRGRQKVVSLTDTTNQKTELQAIHLALQDSGLEVNIVTDSQYALGIIHAQPDKSESELVNQIIEQLINKERIYLSWVPAHKGIGENEQVDKLVSKGIRKVLFLDGIEKAQEEHEKYHSNWKAMASEFNLPPVVAKEIVACCDKCQLKGEALHGQVDCSPGMWQLDCTHLEGKIIIVAVHVASGYIEAEVIPTETGQETAYFLLKLAGRWPVKTIHTDNGSNFTSTTVKAACWWAGIKQEFGIPYNPQSQGVVESINKELKKIIGQIRDQAEHLKTAVLMAVFIHNFKRKGGIGGYTAGERIVDIIATDIQTKELQKQITKVQNFRVYYRDSREPLWKGPAKLLWKGEGAVVIQDNNEIKVVPRRKAKILRDYGKQMAGADCVASRQDEN

SEQ ID NO: 166 - protein, 1004 aa, Human immunodeficiency virus 1
FFRENLAFQQGEAREFSSEQTRTNSPTSRELWDGGRDNLPSEAGAERRGTVPSLSFPQITLWQRPLVTVKIGGQLKEALLDTGADDTVLEEINLPGKWKPKLIGGIGGFIKVRQYDQILIEICGKKAIGTVLVGPTPINIIGRNMLTQIGCTLNFPISPIETIPVKLKPGMDGPRVKQWPLTEEKIKALIEICTEMEKEGKISRVGPENPYNTPIFAIKKKNSNRWRKLVDFRELNKRTQDFWEVQLGIPHPGGLKKKKSVTILDVGDAYFSVPLDEDFRKYTAFTIPSINNATPGIRYQYNVLPQGWKGSPAIFQCSMTKILEPFRKQNPEIIIYQYMDDLYVRSDLEIGQHRTKIEELRQHLLKWGFYTPDKKHQKEPPFLWMGYELHPDKWTVQPIKLPEKESWTVNDIQKLVEKLNWASQIYPGIKVKQLCRLLRGAKALTEVIPLTEEAELELEENREILKDPVHGVYYDPTKDLIAEIQKQGDDQWTYQIYQEPYKNLKTGKYAKRRTAHTNDVRQLTEVVQKVATESIVIWGKIPKFKLPIQKETWEIWWTDYWQATWIPEWEFVNTPHLVKLWYQLEKEPIIGAETFYVDGASNRETKKGKAGYVTDRGRQKIVSLTETTNQKAELQAIQLALQDSGSEVNIVTDSQYALGIIQAHPDKSESELVSQIIEQLIKKEKVYLAWVPAHKGIGGNEQIDKLVSNGIRKILFLDGIDKAQEEHEKYHNNWRAMASDFNLPPVVAKEIVASCNKCQLKGEAIHGQVDCSPRIWQLDCTHLEGKVIMVAVHVASGYVEAEVIPAETGQDTAYFILKLAGRWPVKVVHTDNGSNFTSAAFKAACWWANVQQEFGIPYNPQSQGVVEAMNKELKKIIEQVRDQAEHLKTAVQMAVFVHNFKRKGGIGDYSAGERIIDIIATDIQTRELQKQIIKIQNFRVYYRDNRDPIWKGPAKLLWKGEGAVVIQDNSDIKVIPRRKAKIIRDYGKQMAGDDCMAGRQDEDQ

SEQ ID NO: 167 - protein, 1004 aa, Human immunodeficiency virus 1
FFREDLAFLQGKAREFSSEQTRANSPTRRELQVWGRDSNSLSEAGADRQGTVSFNFPQITLWQRPLVTIKIGGQLKEALLDTGADDTVLEDIDLPGKWKPKIIGGIGGFIKVKQYDQILIEICGKRAIGTVLVGPTPVNIIGRNILTQIGCTLNFPISPIDTVPVKLKPGMDGPRIKQWPLTEEKIKALTEICKEMEEEGKISKIGPENPYNTPVFAIKKKDSTKWRKVVDFRELNKGTQDFWEVQLGIPHPAGLKQKKSVTVLDVEDAYFSVPLDKDFRKYTAFTIPSVNNETPGIRYQYNVLPQGWKGSPAIFQSSMTRILEPFRKQNPDIVIYQYMDDLYVGSDLEIGQHRTKVEELRQHLLRWGFTTPDKKHQKDPPFLWMGYELHPDKWTVQPIVLPEKDSWTINDIQKLVGKLNWASQIYSGIKVRQLCKCLRGTKALTEVIPLTKEAELELAENKEILKEPVHGVYYDPSKDLVAEIQKQGQGQWTYQIYQEQYKNLKTGKYARMRGAHTNDVKQLAEAVQKIATESIVIWGKIPKFRLPIQRETWETWWTEYWQATWIPEWEYVNTPPLVKLWYQLEKEPIVGAETFYVDGAANRDTKLGKAGYVTDRGRQKVVPLTDTTNQKTELQAINLALQDSGSKVNIVTDSQYVLGIIQAQPDRSESEIVNQIIEKLIEKDKVYLSWVPAHKGIGGNEQVDKLVSAGIRKVLFLDGIDKAQDEHEKYHSNWRAMASDFNLPPVIAKEIVASCDKCQLKGEATHGQVDCSPGIWQLDCTHLEGKVIIVAVHVASGYIEAEVISAETGQETAYYILKLAGRWPVKIIHTDNGSNFTSTAVKAACWWAGIQQEFGIPYSPQSQGVVESMNKQLKQIIGQVRDQAEQLKTAVQMAVFIHNFKRKGGIGEYSAGERIIDIISTDIQTRELQKQITKIQNFRVYYRDSRDPVWKGPAKLLWKGEGAVVIQDNSEIKVVPRRKAKIIRHYGKQMAGDDCVASRQDEDQ

SEQ ID NO: 168 - protein, 1011 aa, Human immunodeficiency virus 1
FFRENLAFPQGEAREFPSEQARANSPTSRANSPTSRELQVRGDNPRSEAGAERQGTLQGTLNCPQITLWQRPLVSIKVGGQVKEALLDTGADDTVLEEMSLPGKWKPKMVGGIGGFIKVRQYDQILVEICGHKAIGTVLVGPTPVNIIRRNMLTQLRCTLNFPISPIETVPVTLKPGMDGPKVRQWPLTEEKIKALTAICEEMEKEGKITKIGPENPYNTPVFAIRKKDSTKWRKLVDFRELNKKTQDFWEVQLGIPHPSGLKKKKSVTVLDVGDAYFSVPLDEGFRKYTAFTIPSTNNETPGIRYQYNVLPQGWKGSPAIFQSSMIKILEPFRAKNPEIVIYQYMDDLYVGSDLEIGQHRAKVEELREHLLRWGFTTPDKKHQNEPPFLWMGYELHPDKWTVQPIQLPEKDSWTVNDIQRLVGKLNWASQIYAGIKVKQLCKLLRGAKALTDIVPLTEEAELELAENREILKTPVHGVYYDPSKDLIAEIQKQGQDQWSYQIYQEPFKNLKTGKYARTRGAHTNDVRQLTEAVQKIAQECIVIWGKTPKFKLPIQKDTWETWWMDYWQATWIPKWEFVNTPPLVKLWYQLEKDPIAGVETFYVDGAANRETKIGKAGYVTDKGRQKVVTLTETTNQKTELHAIYLALQDSGSEVNVVTDSQYALGIIQAQPDRSESELVNQIIEKLIGKDKVYLSWVPAHKGIGENEQVDKLVSNGIRKVLFLDGIDKAQEDHEKYHSNWRAMANEFNLPPIVAKEIVANCDKCQLKGEAMHGQVDCSPGIWQIDCTHLEGKVILVAVHVASGYLEAEVIPAETGQEAAYFILKLAGRWPVKTVHTDNGSNFTSNAVKAACWWANVRQEFGIPYNPQSQGVIESMNKELKKIIGQVRDQAEHLRTAVQMAVFIHNFKRRGGIGGYSAGERMIDIIATDIQTTELQKQITKIQKFRVYYRDSRDPLWKGPAKLLWKGEGAVVIQENSDIKVVPRRKAKIIKDYGKQVAGADCVAGRQDEDQ

What is claimed is:

1. An isolated mosaic clade M human immunodeficiency virus type 1 (HIV-1) Nef polypeptide comprising an amino acid sequence selected from the group consisting of Nef coreM 4.1 (SEQ ID NO:33), Nef coreM 4.2 (SEQ ID NO:34), Nef coreM 4.3 (SEQ ID NO:35), and Nef coreM 4.4 (SEQ ID NO:36).

2. The polypeptide according to claim 1 wherein said polypeptide comprises the amino acid sequence of Nef coreM 4.1 (SEQ ID NO:33).

3. A composition comprising at least one polypeptide according to claim 1 and a carrier.

4. A method of inducing an immune response in a mammal comprising administering to said mammal an amount of at least one polypeptide according to claim 1 sufficient to effect said induction.

5. The polypeptide according to claim 1 wherein said polypeptide comprises the amino acid sequence of Nef coreM 4.2 (SEQ ID NO:34).

6. The polypeptide according to claim 1 wherein said polypeptide comprises the amino acid sequence of Nef coreM 4.3 (SEQ ID NO:35).

7. The polypeptide according to claim 1 wherein said polypeptide comprises the amino acid sequence of Nef coreM 4.4 (SEQ ID NO:36).

* * * * *